US011542496B2

(12) United States Patent
Liu et al.

(10) Patent No.: US 11,542,496 B2
(45) Date of Patent: Jan. 3, 2023

(54) CYTOSINE TO GUANINE BASE EDITOR

(71) Applicant: President and Fellows of Harvard College, Cambridge, MA (US)

(72) Inventors: David R. Liu, Lexington, MA (US); Luke W. Koblan, Brookline, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 0 days.

(21) Appl. No.: 16/492,553

(22) PCT Filed: Mar. 9, 2018

(86) PCT No.: PCT/US2018/021878
§ 371 (c)(1),
(2) Date: Sep. 9, 2019

(87) PCT Pub. No.: WO2018/165629
PCT Pub. Date: Sep. 13, 2018

(65) Prior Publication Data

US 2021/0230577 A1 Jul. 29, 2021

Related U.S. Application Data

(60) Provisional application No. 62/470,175, filed on Mar. 10, 2017.

(51) Int. Cl.

| | |
|---|---|
| ***C12N 15/10*** | (2006.01) |
| ***C07K 14/47*** | (2006.01) |
| ***C12N 9/22*** | (2006.01) |
| ***C12N 9/24*** | (2006.01) |
| ***C12N 9/78*** | (2006.01) |

(52) U.S. Cl.
CPC ........... *C12N 15/102* (2013.01); *C07K 14/47* (2013.01); *C12N 9/22* (2013.01); *C12N 9/2497* (2013.01); *C12N 9/78* (2013.01); *C07K 2319/80* (2013.01); *C12Y 302/02027* (2013.01); *C12Y 305/04005* (2013.01)

(58) Field of Classification Search
None
See application file for complete search history.

(56) References Cited

U.S. PATENT DOCUMENTS

| | | | |
|---|---|---|---|
| 4,182,449 | A | 1/1980 | Kozlow |
| 4,186,183 | A | 1/1980 | Steck et al. |
| 4,217,344 | A | 8/1980 | Vanlerberghe et al. |
| 4,235,871 | A | 11/1980 | Papahadjopoulos et al. |
| 4,261,975 | A | 4/1981 | Fullerton et al. |
| 4,485,054 | A | 11/1984 | Mezei et al. |
| 4,501,728 | A | 2/1985 | Geho et al. |
| 4,663,290 | A | 5/1987 | Weis et al. |
| 4,737,323 | A | 4/1988 | Martin et al. |
| 4,774,085 | A | 9/1988 | Fidler |
| 4,797,368 | A | 1/1989 | Carter et al. |
| 4,837,028 | A | 6/1989 | Allen |
| 4,873,316 | A | 10/1989 | Meade et al. |
| 4,880,635 | A | 11/1989 | Janoff et al. |
| 4,889,818 | A | 12/1989 | Gelfand et al. |
| 4,897,355 | A | 1/1990 | Eppstein et al. |
| 4,906,477 | A | 3/1990 | Kurono et al. |
| 4,911,928 | A | 3/1990 | Wallach |
| 4,917,951 | A | 4/1990 | Wallach |
| 4,920,016 | A | 4/1990 | Allen et al. |
| 4,921,757 | A | 5/1990 | Wheatley et al. |
| 4,946,787 | A | 8/1990 | Eppstein et al. |
| 4,965,185 | A | 10/1990 | Grischenko et al. |
| 5,017,492 | A | 5/1991 | Kotewicz et al. |
| 5,047,342 | A | 9/1991 | Chatterjee |
| 5,049,386 | A | 9/1991 | Eppstein et al. |
| 5,079,352 | A | 1/1992 | Gelfand et al. |

(Continued)

FOREIGN PATENT DOCUMENTS

| | | | |
|---|---|---|---|
| AU | 2012244264 | A1 | 11/2012 |
| AU | 2012354062 | A1 | 7/2014 |

(Continued)

OTHER PUBLICATIONS

Chen et al.."Targeting genomic rearrangements in tumor cells through Cas0-mediated insertion of a suicide gene", Nature Biotechnology, vol. 35, No. 6, pp. 543-552 Jun. 2017.*
Zhou et al.,"Cas12a variants designed for lower genome-wide off-target effect through stringent PAM recognition", Molecular Therapy, vol. 30, No. 1 , pp. 1-12 Jan. 2022.*
Doudna, "The promise and challenge of therapeutic genome editing", Nature vol. 578 pp. 229-236, Feb. 2020.*
Wan et al.,"Material solutions fordelivery of CRISPR/Cas-based genome editing tools: current status and future outlook", Materials Today vol. 26, pp. 40-66 Jun. 2019.*

(Continued)

*Primary Examiner* — Anand U Desai
(74) *Attorney, Agent, or Firm* — Wolf, Greenfield & Sacks, P.C.

(57) ABSTRACT

Some aspects of this disclosure provide compositions, strategies, systems, reagents, methods, and kits that are useful for the targeted editing of nucleic acids, including editing a single site within the genome of a cell or subject, e.g., within the human genome. In some embodiments, fusion proteins capable of inducing a cytosine (C) to guanine (G) change in a nucleic acid (e.g., genomic DNA) are provided. In some embodiments, fusion proteins of a nucleic acid programmable DNA binding protein (e.g., Cas9) and nucleic acid editing proteins or protein domains, e.g., deaminase domains, polymerase domains, and/or base excision enzymes are provided. In some embodiments, methods for targeted nucleic acid editing are provided. In some embodiments, reagents and kits for the generation of targeted nucleic acid editing proteins, e.g., fusion proteins of a nucleic acid programmable DNA binding protein (e.g., Cas9), and nucleic acid editing proteins or domains, are provided.

31 Claims, 55 Drawing Sheets

Specification includes a Sequence Listing.

(56) References Cited

U.S. PATENT DOCUMENTS

| | | | |
|---|---|---|---|
| 5,139,941 | A | 8/1992 | Muzyczka et al. |
| 5,173,414 | A | 12/1992 | Lebkowski et al. |
| 5,223,409 | A | 6/1993 | Ladner et al. |
| 5,244,797 | A | 9/1993 | Kotewicz et al. |
| 5,270,179 | A | 12/1993 | Chatterjee |
| 5,374,553 | A | 12/1994 | Gelfand et al. |
| 5,405,776 | A | 4/1995 | Kotewicz et al. |
| 5,436,149 | A | 7/1995 | Barnes |
| 5,449,639 | A | 9/1995 | Wei et al. |
| 5,496,714 | A | 3/1996 | Comb et al. |
| 5,512,462 | A | 4/1996 | Cheng |
| 5,580,737 | A | 12/1996 | Polisky et al. |
| 5,614,365 | A | 3/1997 | Tabor et al. |
| 5,658,727 | A | 8/1997 | Barbas et al. |
| 5,668,005 | A | 9/1997 | Kotewicz et al. |
| 5,677,152 | A | 10/1997 | Birch et al. |
| 5,767,099 | A | 6/1998 | Harris et al. |
| 5,780,053 | A | 7/1998 | Ashley et al. |
| 5,830,430 | A | 11/1998 | Unger et al. |
| 5,834,247 | A | 11/1998 | Comb et al. |
| 5,835,699 | A | 11/1998 | Kimura |
| 5,851,548 | A | 12/1998 | Dattagupta et al. |
| 5,855,910 | A | 1/1999 | Ashley et al. |
| 5,962,313 | A | 10/1999 | Podsakoff et al. |
| 5,981,182 | A | 11/1999 | Jacobs, Jr. et al. |
| 6,057,153 | A | 5/2000 | George et al. |
| 6,063,608 | A | 5/2000 | Kotewicz et al. |
| 6,156,509 | A | 12/2000 | Schellenberger |
| 6,183,998 | B1 | 2/2001 | Ivanov et al. |
| 6,429,298 | B1 | 8/2002 | Ellington et al. |
| 6,453,242 | B1 | 9/2002 | Eisenberg et al. |
| 6,479,264 | B1 | 11/2002 | Louwrier |
| 6,503,717 | B2 | 1/2003 | Case et al. |
| 6,534,261 | B1 | 3/2003 | Cox, III et al. |
| 6,589,768 | B1 | 7/2003 | Kotewicz et al. |
| 6,599,692 | B1 | 7/2003 | Case et al. |
| 6,607,882 | B1 | 8/2003 | Cox, III et al. |
| 6,610,522 | B1 | 8/2003 | Kotewicz et al. |
| 6,689,558 | B2 | 2/2004 | Case et al. |
| 6,824,978 | B1 | 11/2004 | Cox, III et al. |
| 6,933,113 | B2 | 8/2005 | Case et al. |
| 6,979,539 | B2 | 12/2005 | Cox, III et al. |
| 7,013,219 | B2 | 3/2006 | Case et al. |
| 7,045,337 | B2 | 5/2006 | Schultz et al. |
| 7,070,928 | B2 | 7/2006 | Liu et al. |
| 7,078,208 | B2 | 7/2006 | Smith et al. |
| 7,083,970 | B2 | 8/2006 | Schultz et al. |
| 7,163,824 | B2 | 1/2007 | Cox, III et al. |
| 7,192,739 | B2 | 3/2007 | Liu et al. |
| 7,223,545 | B2 | 5/2007 | Liu et al. |
| 7,354,761 | B2 | 4/2008 | Schultz et al. |
| 7,368,275 | B2 | 5/2008 | Schultz et al. |
| 7,442,160 | B2 | 10/2008 | Liu et al. |
| 7,476,500 | B1 | 1/2009 | Liu et al. |
| 7,476,734 | B2 | 1/2009 | Liu |
| 7,479,573 | B2 | 1/2009 | Chu et al. |
| 7,491,494 | B2 | 2/2009 | Liu et al. |
| 7,541,450 | B2 | 6/2009 | Liu et al. |
| 7,557,068 | B2 | 7/2009 | Liu et al. |
| 7,595,179 | B2 | 9/2009 | Chen et al. |
| 7,638,300 | B2 | 12/2009 | Schultz et al. |
| 7,670,807 | B2 | 3/2010 | Lampson et al. |
| 7,678,554 | B2 | 3/2010 | Liu et al. |
| 7,713,721 | B2 | 5/2010 | Schultz et al. |
| 7,771,935 | B2 | 8/2010 | Liu et al. |
| 7,794,931 | B2 | 9/2010 | Breaker et al. |
| 7,807,408 | B2 | 10/2010 | Liu et al. |
| 7,851,658 | B2 | 12/2010 | Liu et al. |
| 7,915,025 | B2 | 3/2011 | Schultz et al. |
| 7,919,277 | B2 | 4/2011 | Russell et al. |
| 7,993,672 | B2 | 8/2011 | Huang et al. |
| 7,998,904 | B2 | 8/2011 | Liu et al. |
| 8,012,739 | B2 | 9/2011 | Schultz et al. |
| 8,017,323 | B2 | 9/2011 | Liu et al. |
| 8,017,755 | B2 | 9/2011 | Liu et al. |
| 8,030,074 | B2 | 10/2011 | Schultz et al. |
| 8,067,556 | B2 | 11/2011 | Hogrefe et al. |
| 8,114,648 | B2 | 2/2012 | Schultz et al. |
| 8,173,364 | B2 | 5/2012 | Schultz et al. |
| 8,173,392 | B2 | 5/2012 | Schultz et al. |
| 8,183,012 | B2 | 5/2012 | Schultz et al. |
| 8,183,178 | B2 | 5/2012 | Liu et al. |
| 8,206,914 | B2 | 6/2012 | Liu et al. |
| 8,361,725 | B2 | 1/2013 | Russell et al. |
| 8,394,604 | B2 | 3/2013 | Liu et al. |
| 8,440,431 | B2 | 5/2013 | Voytas et al. |
| 8,440,432 | B2 | 5/2013 | Voytas et al. |
| 8,450,471 | B2 | 5/2013 | Voytas et al. |
| 8,492,082 | B2 | 7/2013 | De Franciscis et al. |
| 8,546,553 | B2 | 10/2013 | Terns et al. |
| 8,569,256 | B2 | 10/2013 | Heyes et al. |
| 8,586,363 | B2 | 11/2013 | Voytas et al. |
| 8,680,069 | B2 | 3/2014 | de Fougerolles et al. |
| 8,691,729 | B2 | 4/2014 | Liu et al. |
| 8,691,750 | B2 | 4/2014 | Constien et al. |
| 8,697,359 | B1 | 4/2014 | Zhang |
| 8,697,853 | B2 | 4/2014 | Voytas et al. |
| 8,709,466 | B2 | 4/2014 | Coady et al. |
| 8,728,526 | B2 | 5/2014 | Heller |
| 8,748,667 | B2 | 6/2014 | Budzik et al. |
| 8,758,810 | B2 | 6/2014 | Okada et al. |
| 8,759,103 | B2 | 6/2014 | Kim et al. |
| 8,759,104 | B2 | 6/2014 | Unciti-Broceta et al. |
| 8,771,728 | B2 | 7/2014 | Huang et al. |
| 8,790,664 | B2 | 7/2014 | Pitard et al. |
| 8,795,965 | B2 | 8/2014 | Zhang |
| 8,822,663 | B2 | 9/2014 | Schrum et al. |
| 8,846,578 | B2 | 9/2014 | McCray et al. |
| 8,889,418 | B2 | 11/2014 | Zhang et al. |
| 8,900,814 | B2 | 12/2014 | Yasukawa et al. |
| 8,975,232 | B2 | 3/2015 | Liu et al. |
| 8,993,233 | B2 | 3/2015 | Zhang et al. |
| 8,999,641 | B2 | 4/2015 | Zhang et al. |
| 9,023,594 | B2 | 5/2015 | Liu et al. |
| 9,068,179 | B1 | 6/2015 | Liu et al. |
| 9,150,626 | B2 | 10/2015 | Liu et al. |
| 9,163,271 | B2 | 10/2015 | Schultz et al. |
| 9,163,284 | B2 | 10/2015 | Liu et al. |
| 9,181,535 | B2 | 11/2015 | Liu et al. |
| 9,200,045 | B2 | 12/2015 | Liu et al. |
| 9,221,886 | B2 | 12/2015 | Liu et al. |
| 9,228,207 | B2 | 1/2016 | Liu et al. |
| 9,234,213 | B2 | 1/2016 | Wu |
| 9,243,038 | B2 | 1/2016 | Liu et al. |
| 9,267,127 | B2 | 2/2016 | Liu et al. |
| 9,322,006 | B2 | 4/2016 | Liu et al. |
| 9,322,037 | B2 | 4/2016 | Liu et al. |
| 9,340,799 | B2 | 5/2016 | Liu et al. |
| 9,340,800 | B2 | 5/2016 | Liu et al. |
| 9,359,599 | B2 | 6/2016 | Liu et al. |
| 9,388,430 | B2 | 7/2016 | Liu et al. |
| 9,394,537 | B2 | 7/2016 | Liu et al. |
| 9,434,774 | B2 | 9/2016 | Liu et al. |
| 9,458,484 | B2 | 10/2016 | Ma et al. |
| 9,512,446 | B1 | 12/2016 | Joung et al. |
| 9,526,724 | B2 | 12/2016 | Oshiack et al. |
| 9,526,784 | B2 | 12/2016 | Liu et al. |
| 9,534,210 | B2 | 1/2017 | Park et al. |
| 9,580,698 | B1 | 2/2017 | Xu et al. |
| 9,610,322 | B2 | 4/2017 | Liu et al. |
| 9,637,739 | B2 | 5/2017 | Siksnys et al. |
| 9,737,604 | B2 | 8/2017 | Jin et al. |
| 9,738,693 | B2 | 8/2017 | Telford et al. |
| 9,753,340 | B2 | 9/2017 | Saitou |
| 9,771,574 | B2 | 9/2017 | Liu et al. |
| 9,783,791 | B2 | 10/2017 | Hogrefe et al. |
| 9,816,093 | B1 | 11/2017 | Donohoue et al. |
| 9,840,538 | B2 | 12/2017 | Telford et al. |
| 9,840,690 | B2 | 12/2017 | Karli et al. |
| 9,840,699 | B2 | 12/2017 | Liu et al. |
| 9,840,702 | B2 | 12/2017 | Collingwood et al. |
| 9,850,521 | B2 | 12/2017 | Braman et al. |
| 9,873,907 | B2 | 1/2018 | Zeiner et al. |
| 9,879,270 | B2 | 1/2018 | Hittinger et al. |

(56) References Cited

U.S. PATENT DOCUMENTS

| | | | |
|---|---|---|---|
| 9,932,567 | B1 | 4/2018 | Xu et al. |
| 9,938,288 | B1 | 4/2018 | Kishi et al. |
| 9,944,933 | B2 | 4/2018 | Storici et al. |
| 9,982,279 | B1 | 5/2018 | Gill et al. |
| 9,999,671 | B2 | 6/2018 | Liu et al. |
| 10,011,868 | B2 | 7/2018 | Liu et al. |
| 10,053,725 | B2 | 8/2018 | Liu et al. |
| 10,059,940 | B2 | 8/2018 | Zhong |
| 10,077,453 | B2 | 9/2018 | Liu et al. |
| 10,113,163 | B2 | 10/2018 | Liu et al. |
| 10,150,955 | B2 | 12/2018 | Lambowitz et al. |
| 10,167,457 | B2 | 1/2019 | Liu et al. |
| 10,179,911 | B2 | 1/2019 | Liu et al. |
| 10,189,831 | B2 | 1/2019 | Arrington et al. |
| 10,202,593 | B2 | 2/2019 | Liu et al. |
| 10,202,658 | B2 | 2/2019 | Parkin et al. |
| 10,227,581 | B2 | 3/2019 | Liu et al. |
| 10,323,236 | B2 | 6/2019 | Liu et al. |
| 10,336,997 | B2 | 7/2019 | Liu et al. |
| 10,358,670 | B2 | 7/2019 | Janulaitis et al. |
| 10,392,674 | B2 | 8/2019 | Liu et al. |
| 10,407,474 | B2 | 9/2019 | Liu et al. |
| 10,407,697 | B2 | 9/2019 | Doudna et al. |
| 10,465,176 | B2 | 11/2019 | Liu et al. |
| 10,508,298 | B2 | 12/2019 | Liu et al. |
| 10,583,201 | B2 | 3/2020 | Chen et al. |
| 10,597,679 | B2 | 3/2020 | Liu et al. |
| 10,612,011 | B2 | 4/2020 | Liu et al. |
| 10,682,410 | B2 | 6/2020 | Liu et al. |
| 10,704,062 | B2 | 7/2020 | Liu et al. |
| 10,745,677 | B2 | 8/2020 | Maianti et al. |
| 10,858,639 | B2 | 12/2020 | Liu et al. |
| 10,912,833 | B2 | 2/2021 | Liu et al. |
| 10,930,367 | B2 | 2/2021 | Zhang et al. |
| 10,947,530 | B2 | 3/2021 | Liu et al. |
| 10,954,548 | B2 | 3/2021 | Liu et al. |
| 11,046,948 | B2 | 6/2021 | Liu et al. |
| 11,053,481 | B2 | 7/2021 | Liu et al. |
| 11,124,782 | B2 | 9/2021 | Liu et al. |
| 2003/0082575 | A1 | 5/2003 | Schultz et al. |
| 2003/0087817 | A1 | 5/2003 | Cox et al. |
| 2003/0096337 | A1 | 5/2003 | Hillman et al. |
| 2003/0108885 | A1 | 6/2003 | Schultz et al. |
| 2003/0119764 | A1 | 6/2003 | Loeb et al. |
| 2003/0167533 | A1 | 9/2003 | Yadav et al. |
| 2003/0203480 | A1 | 10/2003 | Kovesdi et al. |
| 2004/0003420 | A1 | 1/2004 | Kuhn et al. |
| 2004/0115184 | A1 | 6/2004 | Smith et al. |
| 2004/0203109 | A1 | 10/2004 | Lal et al. |
| 2005/0136429 | A1 | 6/2005 | Guarente et al. |
| 2005/0222030 | A1 | 10/2005 | Allison |
| 2005/0260626 | A1 | 11/2005 | Lorens et al. |
| 2006/0088864 | A1 | 4/2006 | Smolke et al. |
| 2006/0104984 | A1 | 5/2006 | Littlefield et al. |
| 2006/0246568 | A1 | 11/2006 | Honjo et al. |
| 2007/0264692 | A1 | 11/2007 | Liu et al. |
| 2007/0269817 | A1 | 11/2007 | Shapero |
| 2008/0051317 | A1 | 2/2008 | Church et al. |
| 2008/0124725 | A1 | 5/2008 | Barrangou et al. |
| 2008/0182254 | A1 | 7/2008 | Hall et al. |
| 2008/0220502 | A1 | 9/2008 | Schellenberger et al. |
| 2009/0130718 | A1 | 5/2009 | Short |
| 2009/0215878 | A1 | 8/2009 | Tan et al. |
| 2009/0234109 | A1 | 9/2009 | Han et al. |
| 2010/0076057 | A1 | 3/2010 | Sontheimer et al. |
| 2010/0093617 | A1 | 4/2010 | Barrangou et al. |
| 2010/0104690 | A1 | 4/2010 | Barrangou et al. |
| 2010/0273857 | A1 | 10/2010 | Thakker et al. |
| 2010/0305197 | A1 | 12/2010 | Che |
| 2010/0316643 | A1 | 12/2010 | Eckert et al. |
| 2011/0016540 | A1 | 1/2011 | Weinstein et al. |
| 2011/0059160 | A1 | 3/2011 | Essner et al. |
| 2011/0059502 | A1 | 3/2011 | Chalasani |
| 2011/0104787 | A1 | 5/2011 | Church et al. |
| 2011/0177495 | A1 | 7/2011 | Liu et al. |
| 2011/0189775 | A1 | 8/2011 | Ainley et al. |
| 2011/0189776 | A1 | 8/2011 | Terns et al. |
| 2011/0217739 | A1 | 9/2011 | Terns et al. |
| 2011/0301073 | A1 | 12/2011 | Gregory et al. |
| 2012/0129759 | A1 | 5/2012 | Liu et al. |
| 2012/0141523 | A1 | 6/2012 | Castado et al. |
| 2012/0244601 | A1 | 9/2012 | Bertozzi et al. |
| 2012/0270273 | A1 | 10/2012 | Zhang et al. |
| 2013/0059931 | A1 | 3/2013 | Petersen-Mahrt et al. |
| 2013/0117869 | A1 | 5/2013 | Duchateau et al. |
| 2013/0130248 | A1 | 5/2013 | Haurwitz et al. |
| 2013/0158245 | A1 | 6/2013 | Russell et al. |
| 2013/0165389 | A1 | 6/2013 | Schellenberger et al. |
| 2013/0309720 | A1 | 11/2013 | Schultz et al. |
| 2013/0344117 | A1 | 12/2013 | Mirosevich et al. |
| 2013/0345064 | A1 | 12/2013 | Liu et al. |
| 2014/0004280 | A1 | 1/2014 | Loomis |
| 2014/0005269 | A1 | 1/2014 | Ngwuluka et al. |
| 2014/0017214 | A1 | 1/2014 | Cost |
| 2014/0018404 | A1 | 1/2014 | Chen et al. |
| 2014/0044793 | A1 | 2/2014 | Goll et al. |
| 2014/0065711 | A1 | 3/2014 | Liu et al. |
| 2014/0068797 | A1 | 3/2014 | Doudna et al. |
| 2014/0127752 | A1 | 5/2014 | Zhou et al. |
| 2014/0141094 | A1 | 5/2014 | Smyth et al. |
| 2014/0141487 | A1 | 5/2014 | Feldman et al. |
| 2014/0179770 | A1 | 6/2014 | Zhang et al. |
| 2014/0186843 | A1 | 7/2014 | Zhang et al. |
| 2014/0186958 | A1 | 7/2014 | Zhang et al. |
| 2014/0201858 | A1 | 7/2014 | Ostertag et al. |
| 2014/0234289 | A1 | 8/2014 | Liu et al. |
| 2014/0248702 | A1 | 9/2014 | Zhang et al. |
| 2014/0273037 | A1 | 9/2014 | Wu |
| 2014/0273226 | A1 | 9/2014 | Wu |
| 2014/0273230 | A1 | 9/2014 | Chen et al. |
| 2014/0273234 | A1 | 9/2014 | Zhang et al. |
| 2014/0295556 | A1 | 10/2014 | Joung et al. |
| 2014/0295557 | A1 | 10/2014 | Joung et al. |
| 2014/0342456 | A1 | 11/2014 | Mali et al. |
| 2014/0342457 | A1 | 11/2014 | Mali et al. |
| 2014/0342458 | A1 | 11/2014 | Mali et al. |
| 2014/0349400 | A1 | 11/2014 | Jakimo et al. |
| 2014/0356867 | A1 | 12/2014 | Peter et al. |
| 2014/0356956 | A1 | 12/2014 | Church et al. |
| 2014/0356958 | A1 | 12/2014 | Mali et al. |
| 2014/0356959 | A1 | 12/2014 | Church et al. |
| 2014/0357523 | A1 | 12/2014 | Zeiner et al. |
| 2014/0377868 | A1 | 12/2014 | Joung et al. |
| 2015/0010526 | A1 | 1/2015 | Liu et al. |
| 2015/0031089 | A1 | 1/2015 | Lindstrom |
| 2015/0031132 | A1 | 1/2015 | Church et al. |
| 2015/0031133 | A1 | 1/2015 | Church et al. |
| 2015/0044191 | A1 | 2/2015 | Liu et al. |
| 2015/0044192 | A1 | 2/2015 | Liu et al. |
| 2015/0044772 | A1 | 2/2015 | Zhao |
| 2015/0050699 | A1 | 2/2015 | Siksnys et al. |
| 2015/0056177 | A1 | 2/2015 | Liu et al. |
| 2015/0056629 | A1 | 2/2015 | Guthrie-Honea |
| 2015/0064138 | A1 | 3/2015 | Lu et al. |
| 2015/0064789 | A1 | 3/2015 | Paschon et al. |
| 2015/0071898 | A1 | 3/2015 | Liu et al. |
| 2015/0071899 | A1 | 3/2015 | Liu et al. |
| 2015/0071900 | A1 | 3/2015 | Liu et al. |
| 2015/0071901 | A1 | 3/2015 | Liu et al. |
| 2015/0071902 | A1 | 3/2015 | Liu et al. |
| 2015/0071903 | A1 | 3/2015 | Liu et al. |
| 2015/0071906 | A1 | 3/2015 | Liu et al. |
| 2015/0079680 | A1 | 3/2015 | Bradley et al. |
| 2015/0079681 | A1 | 3/2015 | Zhang |
| 2015/0098954 | A1 | 4/2015 | Hyde et al. |
| 2015/0118216 | A1 | 4/2015 | Liu et al. |
| 2015/0132269 | A1 | 5/2015 | Orkin et al. |
| 2015/0140664 | A1 | 5/2015 | Byrne et al. |
| 2015/0159172 | A1 | 6/2015 | Miller et al. |
| 2015/0165054 | A1 | 6/2015 | Liu et al. |
| 2015/0166980 | A1 | 6/2015 | Liu et al. |
| 2015/0166981 | A1 | 6/2015 | Liu et al. |
| 2015/0166982 | A1 | 6/2015 | Liu et al. |
| 2015/0166983 | A1 | 6/2015 | Liu et al. |

(56) References Cited

U.S. PATENT DOCUMENTS

| | | | |
|---|---|---|---|
| 2015/0166984 | A1 | 6/2015 | Liu et al. |
| 2015/0166985 | A1 | 6/2015 | Liu et al. |
| 2015/0191744 | A1 | 7/2015 | Wolfe et al. |
| 2015/0197759 | A1 | 7/2015 | Xu et al. |
| 2015/0211058 | A1 | 7/2015 | Carstens |
| 2015/0218573 | A1 | 8/2015 | Loque et al. |
| 2015/0225773 | A1 | 8/2015 | Farmer et al. |
| 2015/0252358 | A1 | 9/2015 | Maeder et al. |
| 2015/0275202 | A1 | 10/2015 | Liu et al. |
| 2015/0307889 | A1 | 10/2015 | Petolino et al. |
| 2015/0315252 | A1 | 11/2015 | Haugwitz et al. |
| 2015/0344549 | A1 | 12/2015 | Muir et al. |
| 2016/0015682 | A2 | 1/2016 | Cawthorne et al. |
| 2016/0017393 | A1 | 1/2016 | Jacobson et al. |
| 2016/0017396 | A1 | 1/2016 | Cann et al. |
| 2016/0032292 | A1 | 2/2016 | Storici et al. |
| 2016/0032353 | A1 | 2/2016 | Braman et al. |
| 2016/0040155 | A1 | 2/2016 | Maizels et al. |
| 2016/0046952 | A1 | 2/2016 | Hittinger et al. |
| 2016/0046961 | A1 | 2/2016 | Jinek et al. |
| 2016/0046962 | A1 | 2/2016 | May et al. |
| 2016/0053272 | A1 | 2/2016 | Wurtzel et al. |
| 2016/0053304 | A1 | 2/2016 | Wurtzel et al. |
| 2016/0074535 | A1 | 3/2016 | Ranganathan et al. |
| 2016/0076093 | A1 | 3/2016 | Shendure et al. |
| 2016/0090603 | A1 | 3/2016 | Carnes et al. |
| 2016/0090622 | A1 | 3/2016 | Liu et al. |
| 2016/0115488 | A1 | 4/2016 | Zhang et al. |
| 2016/0138046 | A1 | 5/2016 | Wu |
| 2016/0186214 | A1 | 6/2016 | Brouns et al. |
| 2016/0200779 | A1 | 7/2016 | Liu et al. |
| 2016/0201040 | A1 | 7/2016 | Liu et al. |
| 2016/0201089 | A1 | 7/2016 | Gersbach et al. |
| 2016/0206566 | A1 | 7/2016 | Lu et al. |
| 2016/0208243 | A1 | 7/2016 | Zhang et al. |
| 2016/0208288 | A1 | 7/2016 | Liu et al. |
| 2016/0215275 | A1 | 7/2016 | Zhong |
| 2016/0215276 | A1 | 7/2016 | Liu et al. |
| 2016/0215300 | A1 | 7/2016 | May et al. |
| 2016/0244784 | A1 | 8/2016 | Jacobson et al. |
| 2016/0244829 | A1 | 8/2016 | Bang et al. |
| 2016/0264934 | A1 | 9/2016 | Giallourakis et al. |
| 2016/0272593 | A1 | 9/2016 | Ritter et al. |
| 2016/0272965 | A1 | 9/2016 | Zhang et al. |
| 2016/0281072 | A1 | 9/2016 | Zhang |
| 2016/0298136 | A1 | 10/2016 | Chen et al. |
| 2016/0304846 | A1 | 10/2016 | Liu et al. |
| 2016/0304855 | A1 | 10/2016 | Stark et al. |
| 2016/0312304 | A1 | 10/2016 | Sorrentino et al. |
| 2016/0319262 | A1 | 11/2016 | Doudna et al. |
| 2016/0333389 | A1 | 11/2016 | Liu et al. |
| 2016/0340622 | A1 | 11/2016 | Abdou |
| 2016/0340662 | A1 | 11/2016 | Zhang et al. |
| 2016/0345578 | A1 | 12/2016 | Barrangou et al. |
| 2016/0346360 | A1 | 12/2016 | Quake et al. |
| 2016/0346361 | A1 | 12/2016 | Quake et al. |
| 2016/0346362 | A1 | 12/2016 | Quake et al. |
| 2016/0348074 | A1 | 12/2016 | Quake et al. |
| 2016/0348096 | A1 | 12/2016 | Liu et al. |
| 2016/0350476 | A1 | 12/2016 | Quake et al. |
| 2016/0355796 | A1 | 12/2016 | Davidson et al. |
| 2016/0369262 | A1 | 12/2016 | Reik et al. |
| 2017/0009224 | A1 | 1/2017 | Liu et al. |
| 2017/0009242 | A1 | 1/2017 | McKinley et al. |
| 2017/0014449 | A1 | 1/2017 | Bangera et al. |
| 2017/0020922 | A1 | 1/2017 | Wagner et al. |
| 2017/0037432 | A1 | 2/2017 | Donohoue et al. |
| 2017/0044520 | A1 | 2/2017 | Liu et al. |
| 2017/0044592 | A1 | 2/2017 | Peter et al. |
| 2017/0053729 | A1 | 2/2017 | Kotani et al. |
| 2017/0058271 | A1 | 3/2017 | Joung et al. |
| 2017/0058272 | A1 | 3/2017 | Carter et al. |
| 2017/0058298 | A1 | 3/2017 | Kennedy et al. |
| 2017/0073663 | A1 | 3/2017 | Wang et al. |
| 2017/0073670 | A1 | 3/2017 | Nishida et al. |
| 2017/0087224 | A1 | 3/2017 | Quake |
| 2017/0087225 | A1 | 3/2017 | Quake |
| 2017/0088587 | A1 | 3/2017 | Quake |
| 2017/0088828 | A1 | 3/2017 | Quake |
| 2017/0107536 | A1 | 4/2017 | Zhang et al. |
| 2017/0107560 | A1 | 4/2017 | Peter et al. |
| 2017/0114367 | A1 | 4/2017 | Hu et al. |
| 2017/0121693 | A1 | 5/2017 | Liu et al. |
| 2017/0145394 | A1 | 5/2017 | Yeo et al. |
| 2017/0145405 | A1 | 5/2017 | Tang et al. |
| 2017/0145438 | A1 | 5/2017 | Kantor |
| 2017/0152528 | A1 | 6/2017 | Zhang |
| 2017/0152787 | A1 | 6/2017 | Kubo et al. |
| 2017/0159033 | A1 | 6/2017 | Kamtekar et al. |
| 2017/0166928 | A1 | 6/2017 | Vyas et al. |
| 2017/0175104 | A1 | 6/2017 | Doudna et al. |
| 2017/0175142 | A1 | 6/2017 | Zhang et al. |
| 2017/0191047 | A1 | 7/2017 | Terns et al. |
| 2017/0191078 | A1 | 7/2017 | Zhang et al. |
| 2017/0198269 | A1 | 7/2017 | Zhang et al. |
| 2017/0198277 | A1 | 7/2017 | Kmiec et al. |
| 2017/0198302 | A1 | 7/2017 | Feng et al. |
| 2017/0226522 | A1 | 8/2017 | Hu et al. |
| 2017/0233703 | A1 | 8/2017 | Xie et al. |
| 2017/0233756 | A1 | 8/2017 | Begemann et al. |
| 2017/0247671 | A1 | 8/2017 | Yung et al. |
| 2017/0247703 | A1 | 8/2017 | Sloan et al. |
| 2017/0268022 | A1 | 9/2017 | Liu et al. |
| 2017/0275665 | A1 | 9/2017 | Silas et al. |
| 2017/0283797 | A1 | 10/2017 | Robb et al. |
| 2017/0283831 | A1 | 10/2017 | Zhang et al. |
| 2017/0314016 | A1 | 11/2017 | Kim et al. |
| 2017/0362635 | A1 | 12/2017 | Chamberlain et al. |
| 2018/0023062 | A1 | 1/2018 | Lamb et al. |
| 2018/0064077 | A1 | 3/2018 | Dunham et al. |
| 2018/0066258 | A1 | 3/2018 | Powell |
| 2018/0068062 | A1 | 3/2018 | Zhang et al. |
| 2018/0073012 | A1 | 3/2018 | Liu et al. |
| 2018/0080051 | A1 | 3/2018 | Sheikh et al. |
| 2018/0087046 | A1 | 3/2018 | Badran et al. |
| 2018/0100147 | A1 | 4/2018 | Yates et al. |
| 2018/0105867 | A1 | 4/2018 | Xiao et al. |
| 2018/0119118 | A1 | 5/2018 | Lu et al. |
| 2018/0127759 | A1 | 5/2018 | Lu et al. |
| 2018/0127780 | A1 | 5/2018 | Liu et al. |
| 2018/0155708 | A1 | 6/2018 | Church et al. |
| 2018/0155720 | A1 | 6/2018 | Donohoue et al. |
| 2018/0163213 | A1 | 6/2018 | Aneja et al. |
| 2018/0170984 | A1 | 6/2018 | Harris et al. |
| 2018/0179503 | A1 | 6/2018 | Maianti et al. |
| 2018/0179547 | A1 | 6/2018 | Zhang et al. |
| 2018/0201921 | A1 | 7/2018 | Malcolm |
| 2018/0230464 | A1 | 8/2018 | Zhong |
| 2018/0230471 | A1 | 8/2018 | Storici et al. |
| 2018/0236081 | A1 | 8/2018 | Liu et al. |
| 2018/0237758 | A1 | 8/2018 | Liu et al. |
| 2018/0237787 | A1 | 8/2018 | Maianti et al. |
| 2018/0245066 | A1 | 8/2018 | Yao et al. |
| 2018/0258418 | A1 | 9/2018 | Kim |
| 2018/0265864 | A1 | 9/2018 | Li et al. |
| 2018/0273939 | A1 | 9/2018 | Yu et al. |
| 2018/0282722 | A1 | 10/2018 | Jakimo et al. |
| 2018/0298391 | A1 | 10/2018 | Jakimo et al. |
| 2018/0305688 | A1 | 10/2018 | Zhong |
| 2018/0305704 | A1 | 10/2018 | Zhang |
| 2018/0312822 | A1 | 11/2018 | Lee et al. |
| 2018/0312825 | A1 | 11/2018 | Liu et al. |
| 2018/0312828 | A1 | 11/2018 | Liu et al. |
| 2018/0312835 | A1 | 11/2018 | Yao et al. |
| 2018/0327756 | A1 | 11/2018 | Zhang et al. |
| 2018/0346927 | A1 | 12/2018 | Doudna et al. |
| 2019/0010481 | A1 | 1/2019 | Joung et al. |
| 2019/0055543 | A1 | 2/2019 | Tran et al. |
| 2019/0093099 | A1 | 3/2019 | Liu et al. |
| 2019/0185883 | A1 | 6/2019 | Liu et al. |
| 2019/0225955 | A1 | 7/2019 | Liu et al. |
| 2019/0233847 | A1 | 8/2019 | Savage et al. |
| 2019/0241633 | A1 | 8/2019 | Fotin-Mleczek et al. |
| 2019/0256842 | A1 | 8/2019 | Liu et al. |

(56) References Cited

U.S. PATENT DOCUMENTS

| | | | |
|---|---|---|---|
| 2019/0264202 | A1 | 8/2019 | Church et al. |
| 2019/0276816 | A1 | 9/2019 | Liu et al. |
| 2019/0322992 | A1 | 10/2019 | Liu et al. |
| 2019/0352632 | A1 | 11/2019 | Liu et al. |
| 2019/0367891 | A1 | 12/2019 | Liu et al. |
| 2020/0010818 | A1 | 1/2020 | Liu et al. |
| 2020/0010835 | A1 | 1/2020 | Maianti et al. |
| 2020/0063127 | A1 | 2/2020 | Lu et al. |
| 2020/0071722 | A1 | 3/2020 | Liu et al. |
| 2020/0172931 | A1 | 6/2020 | Liu et al. |
| 2020/0181619 | A1 | 6/2020 | Tang et al. |
| 2020/0190493 | A1 | 6/2020 | Liu et al. |
| 2020/0216833 | A1 | 7/2020 | Liu et al. |
| 2020/0255868 | A1 | 8/2020 | Liu et al. |
| 2020/0277587 | A1 | 9/2020 | Liu et al. |
| 2020/0323984 | A1 | 10/2020 | Liu et al. |
| 2020/0399619 | A1 | 12/2020 | Maianti et al. |
| 2020/0399626 | A1 | 12/2020 | Liu et al. |
| 2021/0054416 | A1 | 2/2021 | Liu et al. |
| 2021/0115428 | A1 | 4/2021 | Maianti et al. |
| 2021/0196809 | A1 | 7/2021 | Maianti et al. |
| 2021/0198330 | A1 | 7/2021 | Liu et al. |
| 2021/0214698 | A1 | 7/2021 | Liu et al. |
| 2021/0254127 | A1 | 8/2021 | Liu et al. |
| 2021/0315994 | A1 | 10/2021 | Liu et al. |
| 2021/0317440 | A1 | 10/2021 | Liu et al. |

FOREIGN PATENT DOCUMENTS

| | | | |
|---|---|---|---|
| AU | 2015252023 | A1 | 11/2015 |
| AU | 2015101792 | A4 | 1/2016 |
| AU | 2012354062 | B2 | 9/2017 |
| BR | 112015013786 | A2 | 7/2017 |
| CA | 2894668 | A1 | 6/2014 |
| CA | 2894681 | A1 | 6/2014 |
| CA | 2894684 | A1 | 6/2014 |
| CA | 2 852 593 | A1 | 11/2015 |
| CN | 1069962 | A | 3/1993 |
| CN | 103224947 | A | 7/2013 |
| CN | 103233028 | A | 8/2013 |
| CN | 103388006 | A | 11/2013 |
| CN | 103614415 | A | 3/2014 |
| CN | 103642836 | A | 3/2014 |
| CN | 103668472 | A | 3/2014 |
| CN | 103820441 | A | 5/2014 |
| CN | 103820454 | A | 5/2014 |
| CN | 103911376 | A | 7/2014 |
| CN | 103923911 | A | 7/2014 |
| CN | 103981211 | A | 8/2014 |
| CN | 103981212 | A | 8/2014 |
| CN | 104004778 | A | 8/2014 |
| CN | 104004782 | A | 8/2014 |
| CN | 104017821 | A | 9/2014 |
| CN | 104109687 | A | 10/2014 |
| CN | 104178461 | A | 12/2014 |
| CN | 104342457 | A | 2/2015 |
| CN | 104404036 | A | 3/2015 |
| CN | 104450774 | A | 3/2015 |
| CN | 104480144 | A | 4/2015 |
| CN | 104498493 | A | 4/2015 |
| CN | 104504304 | A | 4/2015 |
| CN | 104531704 | A | 4/2015 |
| CN | 104531705 | A | 4/2015 |
| CN | 104560864 | A | 4/2015 |
| CN | 104561095 | A | 4/2015 |
| CN | 104593418 | A | 5/2015 |
| CN | 104593422 | A | 5/2015 |
| CN | 104611370 | A | 5/2015 |
| CN | 104651392 | A | 5/2015 |
| CN | 104651398 | A | 5/2015 |
| CN | 104651399 | A | 5/2015 |
| CN | 104651401 | A | 5/2015 |
| CN | 104673816 | A | 6/2015 |
| CN | 104725626 | A | 6/2015 |
| CN | 104726449 | A | 6/2015 |
| CN | 104726494 | A | 6/2015 |
| CN | 104745626 | A | 7/2015 |
| CN | 104762321 | A | 7/2015 |
| CN | 104805078 | A | 7/2015 |
| CN | 104805099 | A | 7/2015 |
| CN | 104805118 | A | 7/2015 |
| CN | 104846010 | A | 8/2015 |
| CN | 104894068 | A | 9/2015 |
| CN | 104894075 | A | 9/2015 |
| CN | 104928321 | A | 9/2015 |
| CN | 105039339 | A | 11/2015 |
| CN | 105039399 | A | 11/2015 |
| CN | 105063061 | A | 11/2015 |
| CN | 105087620 | A | 11/2015 |
| CN | 105112422 | A | 12/2015 |
| CN | 105112445 | A | 12/2015 |
| CN | 105112519 | A | 12/2015 |
| CN | 105121648 | A | 12/2015 |
| CN | 105132427 | A | 12/2015 |
| CN | 105132451 | A | 12/2015 |
| CN | 105177038 | A | 12/2015 |
| CN | 105177126 | A | 12/2015 |
| CN | 105210981 | A | 1/2016 |
| CN | 105219799 | A | 1/2016 |
| CN | 105238806 | A | 1/2016 |
| CN | 105255937 | A | 1/2016 |
| CN | 105274144 | A | 1/2016 |
| CN | 105296518 | A | 2/2016 |
| CN | 105296537 | A | 2/2016 |
| CN | 105316324 | A | 2/2016 |
| CN | 105316327 | A | 2/2016 |
| CN | 105316337 | A | 2/2016 |
| CN | 105331607 | A | 2/2016 |
| CN | 105331608 | A | 2/2016 |
| CN | 105331609 | A | 2/2016 |
| CN | 105331627 | A | 2/2016 |
| CN | 105400773 | A | 3/2016 |
| CN | 105400779 | A | 3/2016 |
| CN | 105400810 | A | 3/2016 |
| CN | 105441451 | A | 3/2016 |
| CN | 105462968 | A | 4/2016 |
| CN | 105463003 | A | 4/2016 |
| CN | 105463027 | A | 4/2016 |
| CN | 105492608 | A | 4/2016 |
| CN | 105492609 | A | 4/2016 |
| CN | 105505976 | A | 4/2016 |
| CN | 105505979 | A | 4/2016 |
| CN | 105518134 | A | 4/2016 |
| CN | 105518135 | A | 4/2016 |
| CN | 105518137 | A | 4/2016 |
| CN | 105518138 | A | 4/2016 |
| CN | 105518139 | A | 4/2016 |
| CN | 105518140 | A | 4/2016 |
| CN | 105543228 | A | 5/2016 |
| CN | 105543266 | A | 5/2016 |
| CN | 105543270 | A | 5/2016 |
| CN | 105567688 | A | 5/2016 |
| CN | 105567689 | A | 5/2016 |
| CN | 105567734 | A | 5/2016 |
| CN | 105567735 | A | 5/2016 |
| CN | 105567738 | A | 5/2016 |
| CN | 105593367 | A | 5/2016 |
| CN | 105594664 | A | 5/2016 |
| CN | 105602987 | A | 5/2016 |
| CN | 105624146 | A | 6/2016 |
| CN | 105624187 | A | 6/2016 |
| CN | 105646719 | A | 6/2016 |
| CN | 105647922 | A | 6/2016 |
| CN | 105647962 | A | 6/2016 |
| CN | 105647968 | A | 6/2016 |
| CN | 105647969 | A | 6/2016 |
| CN | 105671070 | A | 6/2016 |
| CN | 105671083 | A | 6/2016 |
| CN | 105695485 | A | 6/2016 |
| CN | 105779448 | A | 7/2016 |
| CN | 105779449 | A | 7/2016 |
| CN | 105802980 | A | 7/2016 |
| CN | 105821039 | A | 8/2016 |
| CN | 105821040 | A | 8/2016 |

(56) References Cited

FOREIGN PATENT DOCUMENTS

| | | | |
|---|---|---|---|
| CN | 105821049 | A | 8/2016 |
| CN | 105821072 | A | 8/2016 |
| CN | 105821075 | A | 8/2016 |
| CN | 105821116 | A | 8/2016 |
| CN | 105838733 | A | 8/2016 |
| CN | 105861547 | A | 8/2016 |
| CN | 105861552 | A | 8/2016 |
| CN | 105861554 | A | 8/2016 |
| CN | 105886498 | A | 8/2016 |
| CN | 105886534 | A | 8/2016 |
| CN | 105886616 | A | 8/2016 |
| CN | 105907758 | A | 8/2016 |
| CN | 105907785 | A | 8/2016 |
| CN | 105925608 | A | 9/2016 |
| CN | 105950560 | A | 9/2016 |
| CN | 105950626 | A | 9/2016 |
| CN | 105950633 | A | 9/2016 |
| CN | 105950639 | A | 9/2016 |
| CN | 105985985 | A | 10/2016 |
| CN | 106011104 | A | 10/2016 |
| CN | 106011150 | A | 10/2016 |
| CN | 106011167 | A | 10/2016 |
| CN | 106011171 | A | 10/2016 |
| CN | 106032540 | A | 10/2016 |
| CN | 106047803 | A | 10/2016 |
| CN | 106047877 | A | 10/2016 |
| CN | 106047930 | A | 10/2016 |
| CN | 106086008 | A | 11/2016 |
| CN | 106086028 | A | 11/2016 |
| CN | 106086061 | A | 11/2016 |
| CN | 106086062 | A | 11/2016 |
| CN | 106109417 | A | 11/2016 |
| CN | 106119275 | A | 11/2016 |
| CN | 106119283 | A | 11/2016 |
| CN | 106148286 | A | 11/2016 |
| CN | 106148370 | A | 11/2016 |
| CN | 106148416 | A | 11/2016 |
| CN | 106167525 | A | 11/2016 |
| CN | 106167808 | A | 11/2016 |
| CN | 106167810 | A | 11/2016 |
| CN | 106167821 | A | 11/2016 |
| CN | 106172238 | A | 12/2016 |
| CN | 106190903 | A | 12/2016 |
| CN | 106191057 | A | 12/2016 |
| CN | 106191061 | A | 12/2016 |
| CN | 106191062 | A | 12/2016 |
| CN | 106191064 | A | 12/2016 |
| CN | 106191071 | A | 12/2016 |
| CN | 106191099 | A | 12/2016 |
| CN | 106191107 | A | 12/2016 |
| CN | 106191113 | A | 12/2016 |
| CN | 106191114 | A | 12/2016 |
| CN | 106191116 | A | 12/2016 |
| CN | 106191124 | A | 12/2016 |
| CN | 106222177 | A | 12/2016 |
| CN | 106222193 | A | 12/2016 |
| CN | 106222203 | A | 12/2016 |
| CN | 106244555 | A | 12/2016 |
| CN | 106244557 | A | 12/2016 |
| CN | 106244591 | A | 12/2016 |
| CN | 106244609 | A | 12/2016 |
| CN | 106282241 | A | 1/2017 |
| CN | 106318934 | A | 1/2017 |
| CN | 106318973 | A | 1/2017 |
| CN | 106350540 | A | 1/2017 |
| CN | 106367435 | A | 2/2017 |
| CN | 106399306 | A | 2/2017 |
| CN | 106399311 | A | 2/2017 |
| CN | 106399360 | A | 2/2017 |
| CN | 106399367 | A | 2/2017 |
| CN | 106399375 | A | 2/2017 |
| CN | 106399377 | A | 2/2017 |
| CN | 106434651 | A | 2/2017 |
| CN | 106434663 | A | 2/2017 |
| CN | 106434688 | A | 2/2017 |
| CN | 106434737 | A | 2/2017 |
| CN | 106434748 | A | 2/2017 |
| CN | 106434752 | A | 2/2017 |
| CN | 106434782 | A | 2/2017 |
| CN | 106446600 | A | 2/2017 |
| CN | 106479985 | A | 3/2017 |
| CN | 106480027 | A | 3/2017 |
| CN | 106480036 | A | 3/2017 |
| CN | 106480067 | A | 3/2017 |
| CN | 106480080 | A | 3/2017 |
| CN | 106480083 | A | 3/2017 |
| CN | 106480097 | A | 3/2017 |
| CN | 106544351 | A | 3/2017 |
| CN | 106544353 | A | 3/2017 |
| CN | 106544357 | A | 3/2017 |
| CN | 106554969 | A | 4/2017 |
| CN | 106566838 | A | 4/2017 |
| CN | 106701763 | A | 5/2017 |
| CN | 106701808 | A | 5/2017 |
| CN | 106701818 | A | 5/2017 |
| CN | 106701823 | A | 5/2017 |
| CN | 106701830 | A | 5/2017 |
| CN | 106754912 | A | 5/2017 |
| CN | 106755026 | A | 5/2017 |
| CN | 106755077 | A | 5/2017 |
| CN | 106755088 | A | 5/2017 |
| CN | 106755091 | A | 5/2017 |
| CN | 106755097 | A | 5/2017 |
| CN | 106755424 | A | 5/2017 |
| CN | 106801056 | A | 6/2017 |
| CN | 106834323 | A | 6/2017 |
| CN | 106834341 | A | 6/2017 |
| CN | 106834347 | A | 6/2017 |
| CN | 106845151 | A | 6/2017 |
| CN | 106868008 | A | 6/2017 |
| CN | 106868031 | A | 6/2017 |
| CN | 106906240 | A | 6/2017 |
| CN | 106906242 | A | 6/2017 |
| CN | 106916820 | A | 7/2017 |
| CN | 106916852 | A | 7/2017 |
| CN | 106939303 | A | 7/2017 |
| CN | 106947750 | A | 7/2017 |
| CN | 106947780 | A | 7/2017 |
| CN | 106957830 | A | 7/2017 |
| CN | 106957831 | A | 7/2017 |
| CN | 106957844 | A | 7/2017 |
| CN | 106957855 | A | 7/2017 |
| CN | 106957858 | A | 7/2017 |
| CN | 106967697 | A | 7/2017 |
| CN | 106967726 | A | 7/2017 |
| CN | 106978428 | A | 7/2017 |
| CN | 106987570 | A | 7/2017 |
| CN | 106987757 | A | 7/2017 |
| CN | 107012164 | A | 8/2017 |
| CN | 107012174 | A | 8/2017 |
| CN | 107012213 | A | 8/2017 |
| CN | 107012250 | A | 8/2017 |
| CN | 107022562 | A | 8/2017 |
| CN | 107034188 | A | 8/2017 |
| CN | 107034218 | A | 8/2017 |
| CN | 107034229 | A | 8/2017 |
| CN | 107043775 | A | 8/2017 |
| CN | 107043779 | A | 8/2017 |
| CN | 107043787 | A | 8/2017 |
| CN | 107058320 | A | 8/2017 |
| CN | 107058328 | A | 8/2017 |
| CN | 107058358 | A | 8/2017 |
| CN | 107058372 | A | 8/2017 |
| CN | 107083392 | A | 8/2017 |
| CN | 107099533 | A | 8/2017 |
| CN | 107099850 | A | 8/2017 |
| CN | 107119053 | A | 9/2017 |
| CN | 107119071 | A | 9/2017 |
| CN | 107129999 | A | 9/2017 |
| CN | 107130000 | A | 9/2017 |
| CN | 107142272 | A | 9/2017 |
| CN | 107142282 | A | 9/2017 |
| CN | 107177591 | A | 9/2017 |
| CN | 107177595 | A | 9/2017 |

(56) References Cited

FOREIGN PATENT DOCUMENTS

| | | | |
|---|---|---|---|
| CN | 107177625 | A | 9/2017 |
| CN | 107177631 | A | 9/2017 |
| CN | 107190006 | A | 9/2017 |
| CN | 107190008 | A | 9/2017 |
| CN | 107217042 | A | 9/2017 |
| CN | 107217075 | A | 9/2017 |
| CN | 107227307 | A | 10/2017 |
| CN | 107227352 | A | 10/2017 |
| CN | 107236737 | A | 10/2017 |
| CN | 107236739 | A | 10/2017 |
| CN | 107236741 | A | 10/2017 |
| CN | 107245502 | A | 10/2017 |
| CN | 107254485 | A | 10/2017 |
| CN | 107266541 | A | 10/2017 |
| CN | 107267515 | A | 10/2017 |
| CN | 107287245 | A | 10/2017 |
| CN | 107298701 | A | 10/2017 |
| CN | 107299114 | A | 10/2017 |
| CN | 107304435 | A | 10/2017 |
| CN | 107312785 | A | 11/2017 |
| CN | 107312793 | A | 11/2017 |
| CN | 107312795 | A | 11/2017 |
| CN | 107312798 | A | 11/2017 |
| CN | 107326042 | A | 11/2017 |
| CN | 107326046 | A | 11/2017 |
| CN | 107354156 | A | 11/2017 |
| CN | 107354173 | A | 11/2017 |
| CN | 107356793 | A | 11/2017 |
| CN | 107362372 | A | 11/2017 |
| CN | 107365786 | A | 11/2017 |
| CN | 107365804 | A | 11/2017 |
| CN | 107384894 | A | 11/2017 |
| CN | 107384922 | A | 11/2017 |
| CN | 107384926 | A | 11/2017 |
| CN | 107400677 | A | 11/2017 |
| CN | 107418974 | A | 12/2017 |
| CN | 107435051 | A | 12/2017 |
| CN | 107435069 | A | 12/2017 |
| CN | 107446922 | A | 12/2017 |
| CN | 107446923 | A | 12/2017 |
| CN | 107446924 | A | 12/2017 |
| CN | 107446932 | A | 12/2017 |
| CN | 107446951 | A | 12/2017 |
| CN | 107446954 | A | 12/2017 |
| CN | 107460196 | A | 12/2017 |
| CN | 107474129 | A | 12/2017 |
| CN | 107475300 | A | 12/2017 |
| CN | 107488649 | A | 12/2017 |
| CN | 107502608 | A | 12/2017 |
| CN | 107502618 | A | 12/2017 |
| CN | 107513531 | A | 12/2017 |
| CN | 107519492 | A | 12/2017 |
| CN | 107523567 | A | 12/2017 |
| CN | 107523583 | A | 12/2017 |
| CN | 107541525 | A | 1/2018 |
| CN | 107557373 | A | 1/2018 |
| CN | 107557378 | A | 1/2018 |
| CN | 107557381 | A | 1/2018 |
| CN | 107557390 | A | 1/2018 |
| CN | 107557393 | A | 1/2018 |
| CN | 107557394 | A | 1/2018 |
| CN | 107557455 | A | 1/2018 |
| CN | 107574179 | A | 1/2018 |
| CN | 107586777 | A | 1/2018 |
| CN | 107586779 | A | 1/2018 |
| CN | 107604003 | A | 1/2018 |
| CN | 107619829 | A | 1/2018 |
| CN | 107619837 | A | 1/2018 |
| CN | 107630006 | A | 1/2018 |
| CN | 107630041 | A | 1/2018 |
| CN | 107630042 | A | 1/2018 |
| CN | 107630043 | A | 1/2018 |
| CN | 107641631 | A | 1/2018 |
| CN | 107653256 | A | 2/2018 |
| CN | 107686848 | A | 2/2018 |
| CN | 206970581 | U | 2/2018 |
| CN | 107760652 | A | 3/2018 |
| CN | 107760663 | A | 3/2018 |
| CN | 107760684 | A | 3/2018 |
| CN | 107760715 | A | 3/2018 |
| CN | 107784200 | A | 3/2018 |
| CN | 107794272 | A | 3/2018 |
| CN | 107794276 | A | 3/2018 |
| CN | 107815463 | A | 3/2018 |
| CN | 107828738 | A | 3/2018 |
| CN | 107828794 | A | 3/2018 |
| CN | 107828826 | A | 3/2018 |
| CN | 107828874 | A | 3/2018 |
| CN | 107858346 | A | 3/2018 |
| CN | 107858373 | A | 3/2018 |
| CN | 107880132 | A | 4/2018 |
| CN | 107881184 | A | 4/2018 |
| CN | 107893074 | A | 4/2018 |
| CN | 107893075 | A | 4/2018 |
| CN | 107893076 | A | 4/2018 |
| CN | 107893080 | A | 4/2018 |
| CN | 107893086 | A | 4/2018 |
| CN | 107904261 | A | 4/2018 |
| CN | 107937427 | A | 4/2018 |
| CN | 107937432 | A | 4/2018 |
| CN | 107937501 | A | 4/2018 |
| CN | 107974466 | A | 5/2018 |
| CN | 107988229 | A | 5/2018 |
| CN | 107988246 | A | 5/2018 |
| CN | 107988256 | A | 5/2018 |
| CN | 107988268 | A | 5/2018 |
| CN | 108018316 | A | 5/2018 |
| CN | 108034656 | A | 5/2018 |
| CN | 108048466 | A | 5/2018 |
| CN | 108102940 | A | 6/2018 |
| CN | 108103092 | A | 6/2018 |
| CN | 108103098 | A | 6/2018 |
| CN | 108103586 | A | 6/2018 |
| CN | 108148835 | A | 6/2018 |
| CN | 108148837 | A | 6/2018 |
| CN | 108148873 | A | 6/2018 |
| CN | 108192956 | A | 6/2018 |
| CN | 108251423 | A | 7/2018 |
| CN | 108251451 | A | 7/2018 |
| CN | 108251452 | A | 7/2018 |
| CN | 108342480 | A | 7/2018 |
| CN | 108359691 | A | 8/2018 |
| CN | 108359712 | A | 8/2018 |
| CN | 108384784 | A | 8/2018 |
| CN | 108396027 | A | 8/2018 |
| CN | 108410877 | A | 8/2018 |
| CN | 108410906 | A | 8/2018 |
| CN | 108410907 | A | 8/2018 |
| CN | 108410911 | A | 8/2018 |
| CN | 108424931 | A | 8/2018 |
| CN | 108441519 | A | 8/2018 |
| CN | 108441520 | A | 8/2018 |
| CN | 108486108 | A | 9/2018 |
| CN | 108486111 | A | 9/2018 |
| CN | 108486145 | A | 9/2018 |
| CN | 108486146 | A | 9/2018 |
| CN | 108486154 | A | 9/2018 |
| CN | 108486159 | A | 9/2018 |
| CN | 108486234 | A | 9/2018 |
| CN | 108504657 | A | 9/2018 |
| CN | 108504685 | A | 9/2018 |
| CN | 108504693 | A | 9/2018 |
| CN | 108546712 | A | 9/2018 |
| CN | 108546717 | A | 9/2018 |
| CN | 108546718 | A | 9/2018 |
| CN | 108559730 | A | 9/2018 |
| CN | 108559732 | A | 9/2018 |
| CN | 108559745 | A | 9/2018 |
| CN | 108559760 | A | 9/2018 |
| CN | 108570479 | A | 9/2018 |
| CN | 108588071 | A | 9/2018 |
| CN | 108588123 | A | 9/2018 |
| CN | 108588128 | A | 9/2018 |
| CN | 108588182 | A | 9/2018 |

(56) References Cited

FOREIGN PATENT DOCUMENTS

| | | | |
|---|---|---|---|
| CN | 108610399 | A | 10/2018 |
| CN | 108611364 | A | 10/2018 |
| CN | 108624622 | A | 10/2018 |
| CN | 108642053 | A | 10/2018 |
| CN | 108642055 | A | 10/2018 |
| CN | 108642077 | A | 10/2018 |
| CN | 108642078 | A | 10/2018 |
| CN | 108642090 | A | 10/2018 |
| CN | 108690844 | A | 10/2018 |
| CN | 108707604 | A | 10/2018 |
| CN | 108707620 | A | 10/2018 |
| CN | 108707621 | A | 10/2018 |
| CN | 108707628 | A | 10/2018 |
| CN | 108707629 | A | 10/2018 |
| CN | 108715850 | A | 10/2018 |
| CN | 108728476 | A | 11/2018 |
| CN | 108728486 | A | 11/2018 |
| CN | 108753772 | A | 11/2018 |
| CN | 108753783 | A | 11/2018 |
| CN | 108753813 | A | 11/2018 |
| CN | 108753817 | A | 11/2018 |
| CN | 108753832 | A | 11/2018 |
| CN | 108753835 | A | 11/2018 |
| CN | 108753836 | A | 11/2018 |
| CN | 108795902 | A | 11/2018 |
| CN | 108822217 | A | 11/2018 |
| CN | 108823248 | A | 11/2018 |
| CN | 108823249 | A | 11/2018 |
| CN | 108823291 | A | 11/2018 |
| CN | 108841845 | A | 11/2018 |
| CN | 108853133 | A | 11/2018 |
| CN | 108866093 | A | 11/2018 |
| CN | 108893529 | A | 11/2018 |
| CN | 108913664 | A | 11/2018 |
| CN | 108913691 | A | 11/2018 |
| CN | 108913714 | A | 11/2018 |
| CN | 108913717 | A | 11/2018 |
| CN | 208034188 | U | 11/2018 |
| CN | 109 517 841 | A | 3/2019 |
| EP | 0264166 | A1 | 4/1988 |
| EP | 2604255 | A1 | 6/2013 |
| EP | 2840140 | A1 | 2/2015 |
| EP | 2966170 | A1 | 1/2016 |
| EP | 3009511 | A2 | 4/2016 |
| EP | 3031921 | A1 | 6/2016 |
| EP | 3045537 | A1 | 7/2016 |
| EP | 3 115 457 | A | 1/2017 |
| EP | 3144390 | A1 | 3/2017 |
| EP | 3199632 | A1 | 8/2017 |
| EP | 3216867 | A1 | 9/2017 |
| EP | 3252160 | A1 | 12/2017 |
| EP | 3450553 | B1 | 12/2019 |
| ES | 2740248 | T3 | 2/2020 |
| GB | 2528177 | A | 1/2016 |
| GB | 2 531 454 | A1 | 4/2016 |
| GB | 2542653 | A | 3/2017 |
| HK | 1208045 | A1 | 2/2016 |
| JP | 2007-501626 | A | 2/2007 |
| JP | 2008-515405 | A | 5/2008 |
| JP | 2010-033344 | A | 2/2010 |
| JP | 2010-539929 | A | 12/2010 |
| JP | 2011-081011 | A | 4/2011 |
| JP | 2011-523353 | A | 8/2011 |
| JP | 2012-525146 | A | 10/2012 |
| JP | 2012-210172 | A | 11/2012 |
| JP | 2012-531909 | A | 12/2012 |
| JP | 2015-523856 | A | 8/2015 |
| KR | 101584933 | B1 | 1/2016 |
| KR | 20160133380 | A | 11/2016 |
| KR | 20170037025 | A | 4/2017 |
| KR | 20170037028 | A | 4/2017 |
| KR | 101748575 | B1 | 6/2017 |
| KR | 20170128137 | A | 11/2017 |
| KR | 2018-0022465 | A | 3/2018 |
| RU | 2016104674 | A | 8/2017 |
| RU | 2634395 | C1 | 10/2017 |
| RU | 2652899 | C1 | 5/2018 |
| RU | 2015128057 | A | 3/2019 |
| RU | 2015128098 | A | 3/2019 |
| RU | 2687451 | C1 | 5/2019 |
| RU | 2019112514 | A | 6/2019 |
| RU | 2019127300 | A | 9/2019 |
| RU | 2701850 | C2 | 10/2019 |
| SG | 10201707569 | | 10/2017 |
| SG | 10201710486 | | 1/2018 |
| SG | 10201710487 | | 1/2018 |
| SG | 10201710488 | | 1/2018 |
| TW | I608100 | B | 12/2017 |
| TW | 2018-29773 | A | 8/2018 |
| WO | WO 90/02809 | | 3/1990 |
| WO | WO 91/16024 | A1 | 10/1991 |
| WO | WO 91/17271 | A1 | 11/1991 |
| WO | WO 91/17424 | A1 | 11/1991 |
| WO | WO 92/06188 | A2 | 4/1992 |
| WO | WO 92/06200 | A1 | 4/1992 |
| WO | WO 93/24641 | A2 | 12/1993 |
| WO | WO 94/18316 | A2 | 8/1994 |
| WO | WO 94/026877 | A1 | 11/1994 |
| WO | WO 96/04403 | A1 | 2/1996 |
| WO | WO 96/10640 | A1 | 4/1996 |
| WO | WO 98/32845 | A1 | 7/1998 |
| WO | WO 2001/036452 | A2 | 5/2001 |
| WO | WO 2001/038547 | A2 | 5/2001 |
| WO | WO 2002/059296 | A2 | 8/2002 |
| WO | WO 2002/068676 | A2 | 9/2002 |
| WO | WO 2002/103028 | A2 | 12/2002 |
| WO | WO 2004/007684 | A2 | 1/2004 |
| WO | WO 05/014791 | A2 | 2/2005 |
| WO | WO 2005/019415 | A2 | 3/2005 |
| WO | WO 2006/002547 | A1 | 1/2006 |
| WO | WO 2006/042112 | A2 | 4/2006 |
| WO | WO 2007/025097 | A2 | 3/2007 |
| WO | WO 07/066923 | A1 | 6/2007 |
| WO | WO 2007/136815 | A2 | 11/2007 |
| WO | WO 2007/143574 | A1 | 12/2007 |
| WO | WO 08/005529 | A2 | 1/2008 |
| WO | WO 2008/108989 | A2 | 9/2008 |
| WO | WO 2009/098290 | A1 | 8/2009 |
| WO | WO 2009/134808 | A2 | 11/2009 |
| WO | WO 2010/011961 | A2 | 1/2010 |
| WO | WO 2010/028347 | A2 | 3/2010 |
| WO | WO 2010/054108 | A2 | 5/2010 |
| WO | WO 2010/054154 | A2 | 5/2010 |
| WO | WO 2010/068289 | A2 | 6/2010 |
| WO | WO 2010/075424 | A2 | 7/2010 |
| WO | WO 2010/102257 | A2 | 9/2010 |
| WO | WO 2010/129019 | A2 | 11/2010 |
| WO | WO 2010/129023 | A2 | 11/2010 |
| WO | WO 2010/132092 | A2 | 11/2010 |
| WO | WO 2010/144150 | A2 | 12/2010 |
| WO | WO 2011/002503 | A1 | 1/2011 |
| WO | WO 2011/017293 | A2 | 2/2011 |
| WO | WO 2011/053868 | A1 | 5/2011 |
| WO | WO 2011/053982 | A2 | 5/2011 |
| WO | WO 2011/068810 | A1 | 6/2011 |
| WO | WO 2011/075627 | A1 | 6/2011 |
| WO | WO 2011/091311 | A2 | 7/2011 |
| WO | WO 2011/109031 | A1 | 9/2011 |
| WO | WO 2011/143124 | A2 | 11/2011 |
| WO | WO 2011/147590 | A2 | 12/2011 |
| WO | WO 2011/159369 | A1 | 12/2011 |
| WO | WO 2012/054726 | A1 | 4/2012 |
| WO | WO 2012/065043 | A2 | 5/2012 |
| WO | WO 2012/088381 | A2 | 6/2012 |
| WO | WO 2012/125445 | A2 | 9/2012 |
| WO | WO 2012/138927 | A2 | 10/2012 |
| WO | WO 2012/149470 | A1 | 11/2012 |
| WO | WO 2012/158985 | A2 | 11/2012 |
| WO | WO 2012/158986 | A2 | 11/2012 |
| WO | WO 2012/164565 | A1 | 12/2012 |
| WO | WO 2012/170930 | A1 | 12/2012 |
| WO | WO 2013/012674 | A1 | 1/2013 |
| WO | WO 2013/013105 | A1 | 1/2013 |
| WO | WO 2013/039857 | A1 | 3/2013 |

(56) References Cited

FOREIGN PATENT DOCUMENTS

WO WO 2013/039861 A2 3/2013
WO WO 2013/045632 A1 4/2013
WO WO 2013/047844 A1 4/2013
WO WO 2013/066438 A2 5/2013
WO WO 2013/086441 A2 6/2013
WO WO 2013/086444 A2 6/2013
WO WO 2013/098244 A1 7/2013
WO WO 2013/119602 A1 8/2013
WO WO 2013/126794 A1 8/2013
WO WO 2013/130824 A1 9/2013
WO WO 2013/141680 A1 9/2013
WO WO 2013/142578 A1 9/2013
WO WO 2013/152359 A1 10/2013
WO WO 2013/160230 A1 10/2013
WO WO 2013/166315 A1 11/2013
WO WO 2013/169398 A2 11/2013
WO WO 2013/169802 A1 11/2013
WO WO 2013/176772 A1 11/2013
WO WO 2013/176915 A1 11/2013
WO WO 2013/176916 A1 11/2013
WO WO 2013/181440 A1 12/2013
WO WO 2013/186754 A2 12/2013
WO WO 2013/188037 A2 12/2013
WO WO 2013/188522 A2 12/2013
WO WO 2013/188638 A2 12/2013
WO WO 2013/192278 A1 12/2013
WO WO 2013/142378 A9 1/2014
WO WO 2014/004336 A2 1/2014
WO WO 2014/005042 A2 1/2014
WO WO 2014/011237 A1 1/2014
WO WO 2014/011901 A2 1/2014
WO WO 2014/018423 A2 1/2014
WO WO 2014/020608 A1 2/2014
WO WO 2014/022120 A1 2/2014
WO WO 2014/022702 A2 2/2014
WO WO 2014/036219 A2 3/2014
WO WO 2014/039513 A2 3/2014
WO WO 2014/039523 A1 3/2014
WO WO 2014/039585 A2 3/2014
WO WO 2014/039684 A1 3/2014
WO WO 2014/039692 A2 3/2014
WO WO 2014/039702 A2 3/2014
WO WO 2014/039872 A1 3/2014
WO WO 2014/039970 A1 3/2014
WO WO 2014/041327 A1 3/2014
WO WO 2014/043143 A1 3/2014
WO WO 2014/047103 A2 3/2014
WO WO 2014/055782 A1 4/2014
WO WO 2014/059173 A2 4/2014
WO WO 2014/059255 A1 4/2014
WO WO 2014/065596 A1 5/2014
WO WO 2014/066505 A1 5/2014
WO WO 2014/068346 A2 5/2014
WO WO 2014/070887 A1 5/2014
WO WO 2014/071006 A1 5/2014
WO WO 2014/071219 A1 5/2014
WO WO 2014/071235 A1 5/2014
WO WO 2014/072941 A1 5/2014
WO WO 2014/081729 A1 5/2014
WO WO 2014/081730 A1 5/2014
WO WO 2014/081855 A1 5/2014
WO WO 2014/082644 A1 6/2014
WO WO 2014/085261 A1 6/2014
WO WO 2014/085593 A1 6/2014
WO WO 2014/085830 A2 6/2014
WO WO 2014/089212 A1 6/2014
WO WO 2014/089290 A1 6/2014
WO WO 2014/089348 A1 6/2014
WO WO 2014/089513 A1 6/2014
WO WO 2014/089533 A2 6/2014
WO WO 2014/089541 A2 6/2014
WO WO 2014/093479 A1 6/2014
WO WO 2014/093595 A1 6/2014
WO WO 2014/093622 A2 6/2014
WO WO 2014/093635 A1 6/2014
WO WO 2014/093655 A2 6/2014
WO WO 2014/093661 A2 6/2014
WO WO 2014/093694 A1 6/2014
WO WO 2014/093701 A1 6/2014
WO WO 2014/093709 A1 6/2014
WO WO 2014/093712 A1 6/2014
WO WO 2014/093718 A1 6/2014
WO WO 2014/093736 A1 6/2014
WO WO 2014/093768 A1 6/2014
WO WO 2014/093852 A1 6/2014
WO WO 2014/096972 A2 6/2014
WO WO 2014/099744 A1 6/2014
WO WO 2014/099750 A2 6/2014
WO WO 2014/104878 A1 7/2014
WO WO 2014/110006 A1 7/2014
WO WO 2014/110552 A1 7/2014
WO WO 2014/113493 A1 7/2014
WO WO 2014/123967 A2 8/2014
WO WO 2014/124226 A1 8/2014
WO WO 2014/125668 A1 8/2014
WO WO 2014/127287 A1 8/2014
WO WO 2014/128324 A1 8/2014
WO WO 2014/128659 A1 8/2014
WO WO 2014/130706 A1 8/2014
WO WO 2014/130955 A1 8/2014
WO WO 2014/131833 A1 9/2014
WO WO 2014/138379 A1 9/2014
WO WO 2014/143381 A1 9/2014
WO WO 2014/144094 A1 9/2014
WO WO 2014/144155 A1 9/2014
WO WO 2014/144288 A1 9/2014
WO WO 2014/144592 A2 9/2014
WO WO 2014/144761 A2 9/2014
WO WO 2014/144951 A1 9/2014
WO WO 2014/145599 A2 9/2014
WO WO 2014/145736 A2 9/2014
WO WO 2014/150624 A1 9/2014
WO WO 2014/152432 A2 9/2014
WO WO 2014/152940 A1 9/2014
WO WO 2014/153118 A1 9/2014
WO WO 2014/153470 A2 9/2014
WO WO 2014/158593 A1 10/2014
WO WO 2014/161821 A1 10/2014
WO WO 2014/164466 A1 10/2014
WO WO 2014/165177 A1 10/2014
WO WO 2014/165349 A1 10/2014
WO WO 2014/165612 A2 10/2014
WO WO 2014/165707 A2 10/2014
WO WO 2014/165825 A2 10/2014
WO WO 2014/172458 A1 10/2014
WO WO 2014/172470 A2 10/2014
WO WO 2014/172489 A2 10/2014
WO WO 2014/173955 A1 10/2014
WO WO 2014/182700 A1 11/2014
WO WO 2014/183071 A2 11/2014
WO WO 2014/184143 A1 11/2014
WO WO 2014/184741 A1 11/2014
WO WO 2014/184744 A1 11/2014
WO WO 2014/186585 A2 11/2014
WO WO 2014/186686 A2 11/2014
WO WO 2014/190181 A1 11/2014
WO WO 2014/191128 A1 12/2014
WO WO 2014/191518 A1 12/2014
WO WO 2014/191521 A2 12/2014
WO WO 2014/191525 A1 12/2014
WO WO 2014/191527 A1 12/2014
WO WO 2014/193583 A2 12/2014
WO WO 2014/194190 A1 12/2014
WO WO 2014/197568 A2 12/2014
WO WO 2014/197748 A2 12/2014
WO WO 2014/199358 A1 12/2014
WO WO 2014/200659 A1 12/2014
WO WO 2014/201015 A2 12/2014
WO WO 2014/204578 A1 12/2014
WO WO 2014/204723 A1 12/2014
WO WO 2014/204724 A1 12/2014
WO WO 2014/204725 A1 12/2014
WO WO 2014/204726 A1 12/2014
WO WO 2014/204727 A1 12/2014

(56) References Cited

FOREIGN PATENT DOCUMENTS

WO WO 2014/204728 A1 12/2014
WO WO 2014/204729 A1 12/2014
WO WO 2014/205192 A2 12/2014
WO WO 2014/207043 A1 12/2014
WO WO 2015/002780 A1 1/2015
WO WO 2015/004241 A2 1/2015
WO WO 2015/006290 A1 1/2015
WO WO 2015/006294 A2 1/2015
WO WO 2015/006437 A1 1/2015
WO WO 2015/006498 A2 1/2015
WO WO 2015/006747 A2 1/2015
WO WO 2015/007194 A1 1/2015
WO WO 2015/010114 A1 1/2015
WO WO 2015/011483 A1 1/2015
WO WO 2015/013583 A2 1/2015
WO WO 2015/017866 A1 2/2015
WO WO 2015/018503 A1 2/2015
WO WO 2015/021353 A1 2/2015
WO WO 2015/021426 A1 2/2015
WO WO 2015/021990 A1 2/2015
WO WO 2015/024017 A2 2/2015
WO WO 2015/024986 A1 2/2015
WO WO 2015/026883 A1 2/2015
WO WO 2015/026885 A1 2/2015
WO WO 2015/026886 A1 2/2015
WO WO 2015/026887 A1 2/2015
WO WO 2015/027134 A1 2/2015
WO WO 2015/028969 A2 3/2015
WO WO 2015/030881 A1 3/2015
WO WO 2015/031619 A1 3/2015
WO WO 2015/031775 A1 3/2015
WO WO 2015/032494 A2 3/2015
WO WO 2015/033293 A1 3/2015
WO WO 2015/034872 A2 3/2015
WO WO 2015/034885 A1 3/2015
WO WO 2015/035136 A2 3/2015
WO WO 2015/035139 A2 3/2015
WO WO 2015/035162 A2 3/2015
WO WO 2015/040075 A1 3/2015
WO WO 2015/040402 A1 3/2015
WO WO 2015/042585 A1 3/2015
WO WO 2015/048577 A2 4/2015
WO WO 2015/048690 A1 4/2015
WO WO 2015/048707 A2 4/2015
WO WO 2015/048801 A2 4/2015
WO WO 2015/049897 A1 4/2015
WO WO 2015/051191 A1 4/2015
WO WO 2015/052133 A1 4/2015
WO WO 2015/052231 A2 4/2015
WO WO 2015/052335 A1 4/2015
WO WO 2015/053995 A1 4/2015
WO WO 2015/054253 A1 4/2015
WO WO 2015/054315 A1 4/2015
WO WO 2015/057671 A1 4/2015
WO WO 2015/057834 A1 4/2015
WO WO 2015/057852 A1 4/2015
WO WO 2015/057976 A1 4/2015
WO WO 2015/057980 A1 4/2015
WO WO 2015/059265 A1 4/2015
WO W0 2015/075175 A1 5/2015
WO WO 2015/065964 A1 5/2015
WO WO 2015/066119 A1 5/2015
WO WO 2015/066634 A2 5/2015
WO WO 2015/066636 A2 5/2015
WO WO 2015/066637 A1 5/2015
WO WO 2015/066638 A2 5/2015
WO WO 2015/066643 A1 5/2015
WO WO 2015/069682 A2 5/2015
WO WO 2015/070083 A1 5/2015
WO WO 2015/070193 A1 5/2015
WO WO 2015/070212 A1 5/2015
WO WO 2015/071474 A2 5/2015
WO WO 2015/073683 A2 5/2015
WO WO 2015/073867 A1 5/2015
WO WO 2015/073990 A1 5/2015
WO WO 2015/075056 A1 5/2015
WO WO 2015/075154 A2 5/2015
WO WO 2015/075195 A1 5/2015
WO WO 2015/075557 A2 5/2015
WO WO 2015/077058 A2 5/2015
WO WO 2015/077290 A2 5/2015
WO WO 2015/077318 A1 5/2015
WO WO 2015/079056 A1 6/2015
WO WO 2015/079057 A2 6/2015
WO WO 2015/086795 A1 6/2015
WO WO 2015/086798 A2 6/2015
WO WO 2015/088643 A1 6/2015
WO WO 2015/089046 A1 6/2015
WO WO 2015/089077 A2 6/2015
WO WO 2015/089277 A1 6/2015
WO WO 2015/089351 A1 6/2015
WO WO 2015/089354 A1 6/2015
WO WO 2015/089364 A1 6/2015
WO WO 2015/089406 A1 6/2015
WO WO 2015/089419 A2 6/2015
WO WO 2015/089427 A1 6/2015
WO WO 2015/089462 A1 6/2015
WO WO 2015/089465 A1 6/2015
WO WO 2015/089473 A1 6/2015
WO WO 2015/089486 A1 6/2015
WO WO 2015/095804 A1 6/2015
WO WO 2015/099850 A1 7/2015
WO WO 2015/100929 A1 7/2015
WO WO 2015/103057 A1 7/2015
WO WO 2015/103153 A1 7/2015
WO WO 2015/105928 A1 7/2015
WO WO 2015/108993 A1 7/2015
WO WO 2015/109752 A1 7/2015
WO WO 2015/110474 A1 7/2015
WO WO 2015/112790 A2 7/2015
WO WO 2015/112896 A2 7/2015
WO WO 2015/113063 A1 7/2015
WO WO 2015/114365 A1 8/2015
WO WO 2015/115903 A1 8/2015
WO WO 2015/116686 A1 8/2015
WO WO 2015/116969 A2 8/2015
WO WO 2015/117021 A1 8/2015
WO WO 2015/117041 A1 8/2015
WO WO 2015/117081 A2 8/2015
WO WO 2015/118156 A1 8/2015
WO WO 2015/119941 A2 8/2015
WO WO 2015/121454 A1 8/2015
WO WO 2015/122967 A1 8/2015
WO WO 2015/123339 A1 8/2015
WO WO 2015/124715 A1 8/2015
WO WO 2015/124718 A1 8/2015
WO WO 2015/126927 A2 8/2015
WO WO 2015/127428 A1 8/2015
WO WO 2015/127439 A1 8/2015
WO WO 2015/129686 A1 9/2015
WO WO 2015/131101 A1 9/2015
WO WO 2015/133554 A1 9/2015
WO WO 2015/134121 A2 9/2015
WO WO 2015/134812 A1 9/2015
WO WO 2015/136001 A1 9/2015
WO WO 2015/138510 A1 9/2015
WO WO 2015/138739 A2 9/2015
WO WO 2015/138855 A1 9/2015
WO WO 2015/138870 A2 9/2015
WO WO 2015/139008 A1 9/2015
WO WO 2015/139139 A1 9/2015
WO WO 2015/143046 A2 9/2015
WO WO 2015/143177 A1 9/2015
WO WO 2015/145417 A1 10/2015
WO WO 2015/148431 A1 10/2015
WO WO 2015/148670 A1 10/2015
WO WO 2015/148680 A1 10/2015
WO WO 2015/148760 A1 10/2015
WO WO 2015/148761 A1 10/2015
WO WO 2015/148860 A1 10/2015
WO WO 2015/148863 A2 10/2015
WO WO 2015/153760 A2 10/2015
WO WO 2015/153780 A1 10/2015
WO WO 2015/153789 A1 10/2015

(56) References Cited

FOREIGN PATENT DOCUMENTS

| | | | |
|---|---|---|---|
| WO | WO 2015/153791 | A1 | 10/2015 |
| WO | WO 2015/153889 | A2 | 10/2015 |
| WO | WO 2015/153940 | A1 | 10/2015 |
| WO | WO 2015/155341 | A1 | 10/2015 |
| WO | WO 2015/155686 | A2 | 10/2015 |
| WO | WO 2015/157070 | A2 | 10/2015 |
| WO | WO 2015/157534 | A1 | 10/2015 |
| WO | WO 2015/159068 | A1 | 10/2015 |
| WO | WO 2015/159086 | A1 | 10/2015 |
| WO | WO 2015/159087 | A1 | 10/2015 |
| WO | WO 2015/160683 | A1 | 10/2015 |
| WO | WO 2015/161276 | A2 | 10/2015 |
| WO | WO 2015/163733 | A1 | 10/2015 |
| WO | WO 2015/164740 | A1 | 10/2015 |
| WO | WO 2015/164748 | A1 | 10/2015 |
| WO | WO 2015/165274 | A1 | 11/2015 |
| WO | WO 2015/165275 | A1 | 11/2015 |
| WO | WO 2015/165276 | A1 | 11/2015 |
| WO | WO 2015/166272 | A2 | 11/2015 |
| WO | WO 2015/167766 | A1 | 11/2015 |
| WO | WO 2015/167956 | A1 | 11/2015 |
| WO | WO 2015/168125 | A1 | 11/2015 |
| WO | WO 2015/168158 | A1 | 11/2015 |
| WO | WO 2015/168404 | A1 | 11/2015 |
| WO | WO 2015/168547 | A2 | 11/2015 |
| WO | WO 2015/168800 | A1 | 11/2015 |
| WO | WO 2015/171603 | A1 | 11/2015 |
| WO | WO 2015/171894 | A1 | 11/2015 |
| WO | WO 2015/171932 | A1 | 11/2015 |
| WO | WO 2015/172128 | A1 | 11/2015 |
| WO | WO 2015/173436 | A1 | 11/2015 |
| WO | WO 2015/175642 | A2 | 11/2015 |
| WO | WO 2015/179540 | A1 | 11/2015 |
| WO | WO 2015/183025 | A1 | 12/2015 |
| WO | WO 2015/183026 | A1 | 12/2015 |
| WO | WO 2015/183885 | A1 | 12/2015 |
| WO | WO 2015/184259 | A1 | 12/2015 |
| WO | WO 2015/184262 | A1 | 12/2015 |
| WO | WO 2015/184268 | A1 | 12/2015 |
| WO | WO 2015/188056 | A1 | 12/2015 |
| WO | WO 2015/188065 | A1 | 12/2015 |
| WO | WO 2015/188094 | A1 | 12/2015 |
| WO | WO 2015/188109 | A1 | 12/2015 |
| WO | WO 2015/188132 | A1 | 12/2015 |
| WO | WO 2015/188135 | A1 | 12/2015 |
| WO | WO 2015/188191 | A1 | 12/2015 |
| WO | WO 2015/189693 | A1 | 12/2015 |
| WO | WO 2015/191693 | A2 | 12/2015 |
| WO | WO 2015/191899 | A1 | 12/2015 |
| WO | WO 2015/191911 | A2 | 12/2015 |
| WO | WO 2015/193858 | A1 | 12/2015 |
| WO | WO 2015/195547 | A1 | 12/2015 |
| WO | WO 2015/195621 | A1 | 12/2015 |
| WO | WO 2015/195798 | A1 | 12/2015 |
| WO | WO 2015/198020 | A1 | 12/2015 |
| WO | WO 2015/200334 | A1 | 12/2015 |
| WO | WO 2015/200378 | A1 | 12/2015 |
| WO | WO 2015/200555 | A2 | 12/2015 |
| WO | WO 2015/200805 | A2 | 12/2015 |
| WO | WO 2016/001978 | A1 | 1/2016 |
| WO | WO 2016/004010 | A1 | 1/2016 |
| WO | WO 2016/004318 | A1 | 1/2016 |
| WO | WO 2016/007347 | A1 | 1/2016 |
| WO | WO 2016/007604 | A1 | 1/2016 |
| WO | WO 2016/007948 | A1 | 1/2016 |
| WO | WO 2016/011080 | A2 | 1/2016 |
| WO | WO 2016/011210 | A2 | 1/2016 |
| WO | WO 2016/011428 | A1 | 1/2016 |
| WO | WO 2016/012544 | A2 | 1/2016 |
| WO | WO 2016/012552 | A1 | 1/2016 |
| WO | WO 2016/014409 | A1 | 1/2016 |
| WO | WO 2016/014565 | A2 | 1/2016 |
| WO | WO 2016/014794 | A1 | 1/2016 |
| WO | WO 2016/014837 | A1 | 1/2016 |
| WO | WO 2016/016119 | A1 | 2/2016 |
| WO | WO 2016/016358 | A1 | 2/2016 |
| WO | WO 2016/019144 | A2 | 2/2016 |
| WO | WO 2016/020399 | A1 | 2/2016 |
| WO | WO 2016/021972 | A1 | 2/2016 |
| WO | WO 2016/021973 | A1 | 2/2016 |
| WO | WO 2016/022363 | A2 | 2/2016 |
| WO | WO 2016/022866 | A1 | 2/2016 |
| WO | WO 2016/022931 | A1 | 2/2016 |
| WO | WO 2016/025131 | A1 | 2/2016 |
| WO | WO 2016/025469 | A1 | 2/2016 |
| WO | WO 2016/025759 | A1 | 2/2016 |
| WO | WO 2016/026444 | A1 | 2/2016 |
| WO | WO 2016/028682 | A1 | 2/2016 |
| WO | WO 2016/028843 | A1 | 2/2016 |
| WO | WO 2016/028887 | A1 | 2/2016 |
| WO | WO 2016/033088 | A1 | 3/2016 |
| WO | WO 2016/033230 | A1 | 3/2016 |
| WO | WO 2016/033246 | A1 | 3/2016 |
| WO | WO 2016/033298 | A1 | 3/2016 |
| WO | WO 2016/035044 | A1 | 3/2016 |
| WO | WO 2016/036754 | A1 | 3/2016 |
| WO | WO 2016/037157 | A2 | 3/2016 |
| WO | WO 2016/040030 | A1 | 3/2016 |
| WO | WO 2016/040594 | A1 | 3/2016 |
| WO | WO 2016/044182 | A1 | 3/2016 |
| WO | WO 2016/044416 | A1 | 3/2016 |
| WO | WO 2016/046635 | A1 | 3/2016 |
| WO | WO 2016/049024 | A2 | 3/2016 |
| WO | WO 2016/049163 | A2 | 3/2016 |
| WO | WO 2016/049230 | A1 | 3/2016 |
| WO | WO 2016/049251 | A1 | 3/2016 |
| WO | WO 2016/049258 | A2 | 3/2016 |
| WO | WO 2016/053397 | A2 | 4/2016 |
| WO | WO 2016/054326 | A1 | 4/2016 |
| WO | WO 2016/057061 | A2 | 4/2016 |
| WO | WO 2016/057821 | A2 | 4/2016 |
| WO | WO 2016/057835 | A2 | 4/2016 |
| WO | WO 2016/057850 | A1 | 4/2016 |
| WO | WO 2016/057951 | A2 | 4/2016 |
| WO | WO 2016/057961 | A1 | 4/2016 |
| WO | WO 2016/061073 | A1 | 4/2016 |
| WO | WO 2016/061374 | A1 | 4/2016 |
| WO | WO 2016/061481 | A1 | 4/2016 |
| WO | WO 2016/061523 | A1 | 4/2016 |
| WO | WO 2016/064894 | A2 | 4/2016 |
| WO | WO 2016/065364 | A1 | 4/2016 |
| WO | WO 2016/069282 | A1 | 5/2016 |
| WO | WO 2016/069283 | A1 | 5/2016 |
| WO | WO 2016/069591 | A2 | 5/2016 |
| WO | WO 2016/069774 | A1 | 5/2016 |
| WO | WO 2016/069910 | A1 | 5/2016 |
| WO | WO 2016/069912 | A1 | 5/2016 |
| WO | WO 2016/070037 | A2 | 5/2016 |
| WO | WO 2016/070070 | A1 | 5/2016 |
| WO | WO 2016/070129 | A1 | 5/2016 |
| WO | WO 2016/072399 | A1 | 5/2016 |
| WO | WO 2016/072936 | A1 | 5/2016 |
| WO | WO 2016/073433 | A1 | 5/2016 |
| WO | WO 2016/073559 | A1 | 5/2016 |
| WO | WO 2016/073990 | A2 | 5/2016 |
| WO | WO 2016/075662 | A2 | 5/2016 |
| WO | WO 2016/076672 | A1 | 5/2016 |
| WO | WO 2016/077273 | A1 | 5/2016 |
| WO | WO 2016/077350 | A1 | 5/2016 |
| WO | WO 2016/080097 | A1 | 5/2016 |
| WO | WO 2016/080795 | A1 | 5/2016 |
| WO | WO 2016/081923 | A2 | 5/2016 |
| WO | WO 2016/081924 | A1 | 5/2016 |
| WO | WO 2016/082135 | A1 | 6/2016 |
| WO | WO 2016/083811 | A1 | 6/2016 |
| WO | WO 2016/084084 | A1 | 6/2016 |
| WO | WO 2016/084088 | A1 | 6/2016 |
| WO | WO 2016/086177 | A2 | 6/2016 |
| WO | WO 2016/089433 | A1 | 6/2016 |
| WO | WO 2016/089866 | A1 | 6/2016 |
| WO | WO 2016/089883 | A1 | 6/2016 |
| WO | WO 2016/090385 | A1 | 6/2016 |
| WO | WO 2016/094679 | A1 | 6/2016 |
| WO | WO 2016/094845 | A2 | 6/2016 |

(56) References Cited

FOREIGN PATENT DOCUMENTS

| | | | |
|---|---|---|---|
| WO | WO 2016/094867 | A1 | 6/2016 |
| WO | WO 2016/094872 | A1 | 6/2016 |
| WO | WO 2016/094874 | A1 | 6/2016 |
| WO | WO 2016/094880 | A1 | 6/2016 |
| WO | WO 2016/094888 | A1 | 6/2016 |
| WO | WO 2016/097212 | A1 | 6/2016 |
| WO | WO 2016/097231 | A2 | 6/2016 |
| WO | WO 2016/097751 | A1 | 6/2016 |
| WO | WO 2016/099887 | A1 | 6/2016 |
| WO | WO 2016/100272 | A1 | 6/2016 |
| WO | WO 2016/100389 | A1 | 6/2016 |
| WO | WO 2016/100568 | A1 | 6/2016 |
| WO | WO 2016/100571 | A1 | 6/2016 |
| WO | WO 2016/100951 | A2 | 6/2016 |
| WO | WO 2016/100955 | A2 | 6/2016 |
| WO | WO 2016/100974 | A1 | 6/2016 |
| WO | WO 2016/103233 | A2 | 6/2016 |
| WO | WO 2016/104716 | A1 | 6/2016 |
| WO | WO 2016/106236 | A1 | 6/2016 |
| WO | WO 2016/106239 | A1 | 6/2016 |
| WO | WO 2016/106244 | A1 | 6/2016 |
| WO | WO 2016/106338 | A2 | 6/2016 |
| WO | WO 2016/108926 | A1 | 7/2016 |
| WO | WO 2016/109255 | A1 | 7/2016 |
| WO | WO 2016/109840 | A2 | 7/2016 |
| WO | WO 2016/110214 | A1 | 7/2016 |
| WO | WO 2016/110453 | A1 | 7/2016 |
| WO | WO 2016/110511 | A1 | 7/2016 |
| WO | WO 2016/110512 | A1 | 7/2016 |
| WO | WO 2016/111546 | A2 | 7/2016 |
| WO | WO 2016/112242 | A1 | 7/2016 |
| WO | WO 2016/112351 | A1 | 7/2016 |
| WO | WO 2016/112963 | A1 | 7/2016 |
| WO | WO 2016/113357 | A1 | 7/2016 |
| WO | WO 2016/114972 | A1 | 7/2016 |
| WO | WO 2016/115179 | A1 | 7/2016 |
| WO | WO 2016/115326 | A1 | 7/2016 |
| WO | WO 2016/115355 | A1 | 7/2016 |
| WO | WO 2016/116032 | A1 | 7/2016 |
| WO | WO 2016/120480 | A1 | 8/2016 |
| WO | WO 2016/123071 | A1 | 8/2016 |
| WO | WO 2016/123230 | A1 | 8/2016 |
| WO | WO 2016/123243 | A1 | 8/2016 |
| WO | WO 2016/123578 | A1 | 8/2016 |
| WO | WO 2016/126747 | A1 | 8/2016 |
| WO | WO 2016/130600 | A2 | 8/2016 |
| WO | WO 2016/130697 | A1 | 8/2016 |
| WO | WO 2016/131009 | A1 | 8/2016 |
| WO | WO 2016/132122 | A1 | 8/2016 |
| WO | WO 2016/133165 | A1 | 8/2016 |
| WO | WO 2016/135507 | A1 | 9/2016 |
| WO | WO 2016/135557 | A2 | 9/2016 |
| WO | WO 2016/135558 | A2 | 9/2016 |
| WO | WO 2016/135559 | A2 | 9/2016 |
| WO | WO 2016/137774 | A1 | 9/2016 |
| WO | WO 2016/137949 | A1 | 9/2016 |
| WO | WO 2016/141224 | A1 | 9/2016 |
| WO | WO 2016/141893 | A1 | 9/2016 |
| WO | WO 2016/142719 | A1 | 9/2016 |
| WO | WO 2016/145150 | A2 | 9/2016 |
| WO | WO 2016/148994 | A1 | 9/2016 |
| WO | WO 2016/149484 | A2 | 9/2016 |
| WO | WO 2016/149547 | A1 | 9/2016 |
| WO | WO 2016/150336 | A1 | 9/2016 |
| WO | WO 2016/150855 | A1 | 9/2016 |
| WO | WO 2016/154016 | A2 | 9/2016 |
| WO | WO 2016/154579 | A2 | 9/2016 |
| WO | WO 2016/154596 | A1 | 9/2016 |
| WO | WO 2016/155482 | A1 | 10/2016 |
| WO | WO 2016/161004 | A1 | 10/2016 |
| WO | WO 2016/161207 | A1 | 10/2016 |
| WO | WO 2016/161260 | A1 | 10/2016 |
| WO | WO 2016/161380 | A1 | 10/2016 |
| WO | WO 2016/161446 | A1 | 10/2016 |
| WO | WO 2016/164356 | A1 | 10/2016 |
| WO | WO 2016/164797 | A1 | 10/2016 |
| WO | WO 2016/166340 | A1 | 10/2016 |
| WO | WO 2016/167300 | A1 | 10/2016 |
| WO | WO 2016/168631 | A1 | 10/2016 |
| WO | WO 2016/170484 | A1 | 10/2016 |
| WO | WO 2016/172359 | A2 | 10/2016 |
| WO | WO 2016/172727 | A1 | 10/2016 |
| WO | WO 2016/174056 | A1 | 11/2016 |
| WO | WO 2016/174151 | A1 | 11/2016 |
| WO | WO 2016/174250 | A1 | 11/2016 |
| WO | WO 2016/176191 | A1 | 11/2016 |
| WO | WO 2016/176404 | A1 | 11/2016 |
| WO | WO 2016/176690 | A2 | 11/2016 |
| WO | WO 2016/177682 | A1 | 11/2016 |
| WO | WO 2016/178207 | A1 | 11/2016 |
| WO | WO 2016/179038 | A1 | 11/2016 |
| WO | WO 2016/179112 | A1 | 11/2016 |
| WO | WO 2016/181357 | A1 | 11/2016 |
| WO | WO 2016/182893 | A1 | 11/2016 |
| WO | WO 2016/182917 | A1 | 11/2016 |
| WO | WO 2016/182959 | A1 | 11/2016 |
| WO | WO 2016/183236 | A1 | 11/2016 |
| WO | WO 2016/183298 | A2 | 11/2016 |
| WO | WO 2016/183345 | A1 | 11/2016 |
| WO | WO 2016/183402 | A2 | 11/2016 |
| WO | WO 2016/183438 | A1 | 11/2016 |
| WO | WO 2016/183448 | A1 | 11/2016 |
| WO | WO 2016/184955 | A2 | 11/2016 |
| WO | WO 2016/184989 | A1 | 11/2016 |
| WO | WO 2016/185411 | A1 | 11/2016 |
| WO | WO 2016/186745 | A1 | 11/2016 |
| WO | WO 2016/186772 | A2 | 11/2016 |
| WO | WO 2016/186946 | A1 | 11/2016 |
| WO | WO 2016/186953 | A1 | 11/2016 |
| WO | WO 2016/187717 | A1 | 12/2016 |
| WO | WO 2016/187904 | A1 | 12/2016 |
| WO | WO 2016/191684 | A1 | 12/2016 |
| WO | WO 2016/191869 | A1 | 12/2016 |
| WO | WO 2016/196273 | A1 | 12/2016 |
| WO | WO 2016/196282 | A1 | 12/2016 |
| WO | WO 2016/196308 | A1 | 12/2016 |
| WO | WO 2016/196361 | A1 | 12/2016 |
| WO | WO 2016/196499 | A1 | 12/2016 |
| WO | WO 2016/196539 | A2 | 12/2016 |
| WO | WO 2016/196655 | A1 | 12/2016 |
| WO | WO 2016/196805 | A1 | 12/2016 |
| WO | WO 2016/196887 | A1 | 12/2016 |
| WO | WO 2016/197132 | A1 | 12/2016 |
| WO | WO 2016/197133 | A1 | 12/2016 |
| WO | WO 2016/197354 | A1 | 12/2016 |
| WO | WO 2016/197355 | A1 | 12/2016 |
| WO | WO 2016/197356 | A1 | 12/2016 |
| WO | WO 2016/197357 | A1 | 12/2016 |
| WO | WO 2016/197358 | A1 | 12/2016 |
| WO | WO 2016/197359 | A1 | 12/2016 |
| WO | WO 2016/197360 | A1 | 12/2016 |
| WO | WO 2016/197361 | A1 | 12/2016 |
| WO | WO 2016/197362 | A1 | 12/2016 |
| WO | WO 2016/198361 | A1 | 12/2016 |
| WO | WO 2016/198500 | A1 | 12/2016 |
| WO | WO 2016/200263 | A1 | 12/2016 |
| WO | WO 2016/201047 | A1 | 12/2016 |
| WO | WO 2016/201138 | A1 | 12/2016 |
| WO | WO 2016/201152 | A1 | 12/2016 |
| WO | WO 2016/201153 | A1 | 12/2016 |
| WO | WO 2016/201155 | A1 | 12/2016 |
| WO | WO 2016/205276 | A1 | 12/2016 |
| WO | WO 2016/205613 | A1 | 12/2016 |
| WO | WO 2016/205623 | A1 | 12/2016 |
| WO | WO 2016/205680 | A1 | 12/2016 |
| WO | WO 2016/205688 | A2 | 12/2016 |
| WO | WO 2016/205703 | A1 | 12/2016 |
| WO | WO 2016/205711 | A1 | 12/2016 |
| WO | WO 2016/205728 | A1 | 12/2016 |
| WO | WO 2016/205745 | A2 | 12/2016 |
| WO | WO 2016/205749 | A1 | 12/2016 |
| WO | WO 2016/205759 | A1 | 12/2016 |
| WO | WO 2016/205764 | A1 | 12/2016 |
| WO | WO 2017/001572 | A1 | 1/2017 |

(56) References Cited

FOREIGN PATENT DOCUMENTS

| | | | |
|---|---|---|---|
| WO | WO 2017/001988 | A1 | 1/2017 |
| WO | WO 2017/004261 | A1 | 1/2017 |
| WO | WO 2017/004279 | A2 | 1/2017 |
| WO | WO 2017/004616 | A1 | 1/2017 |
| WO | WO 2017/005807 | A1 | 1/2017 |
| WO | WO 2017/009399 | A1 | 1/2017 |
| WO | WO 2017/010556 | A1 | 1/2017 |
| WO | WO 2017/011519 | A1 | 1/2017 |
| WO | WO 2017/011721 | A1 | 1/2017 |
| WO | WO 2017/011804 | A1 | 1/2017 |
| WO | WO 2017/015015 | A1 | 1/2017 |
| WO | WO 2017/015101 | A1 | 1/2017 |
| WO | WO 2017/015545 | A1 | 1/2017 |
| WO | WO 2017/015567 | A1 | 1/2017 |
| WO | WO 2017/015637 | A1 | 1/2017 |
| WO | WO 2017/017016 | A1 | 2/2017 |
| WO | WO 2017/019867 | A1 | 2/2017 |
| WO | WO 2017/019895 | A1 | 2/2017 |
| WO | WO 2017/023803 | A1 | 2/2017 |
| WO | WO 2017/023974 | A1 | 2/2017 |
| WO | WO 2017/024047 | A1 | 2/2017 |
| WO | WO 2017/024319 | A1 | 2/2017 |
| WO | WO 2017/024343 | A1 | 2/2017 |
| WO | WO 2017/024602 | A1 | 2/2017 |
| WO | WO 2017/025323 | A1 | 2/2017 |
| WO | WO 2017/027423 | A1 | 2/2017 |
| WO | WO 2017/028768 | A1 | 2/2017 |
| WO | WO 2017/029664 | A1 | 2/2017 |
| WO | WO 2017/031360 | A1 | 2/2017 |
| WO | WO 2017/031483 | A1 | 2/2017 |
| WO | WO 2017/035416 | A2 | 3/2017 |
| WO | WO 2017/040348 | A1 | 3/2017 |
| WO | WO 2017/040511 | A1 | 3/2017 |
| WO | WO 2017/040709 | A1 | 3/2017 |
| WO | WO 2017/040786 | A1 | 3/2017 |
| WO | WO 2017/040793 | A1 | 3/2017 |
| WO | WO 2017/040813 | A2 | 3/2017 |
| WO | WO 2017/043573 | A1 | 3/2017 |
| WO | WO 2017/043656 | A1 | 3/2017 |
| WO | WO 2017/044419 | A1 | 3/2017 |
| WO | WO 2017/044776 | A1 | 3/2017 |
| WO | WO 2017/044857 | A2 | 3/2017 |
| WO | WO 2017/048390 | A1 | 3/2017 |
| WO | WO 2017/049129 | A2 | 3/2017 |
| WO | WO 2017/050963 | A1 | 3/2017 |
| WO | WO 2017/053312 | A1 | 3/2017 |
| WO | WO 2017/053431 | A2 | 3/2017 |
| WO | WO 2017/053713 | A1 | 3/2017 |
| WO | WO 2017/053729 | A1 | 3/2017 |
| WO | WO 2017/053753 | A1 | 3/2017 |
| WO | WO 2017/053762 | A1 | 3/2017 |
| WO | WO 2017/053879 | A1 | 3/2017 |
| WO | WO 2017/054721 | A1 | 4/2017 |
| WO | WO 2017/058658 | A2 | 4/2017 |
| WO | WO 2017/059241 | A1 | 4/2017 |
| WO | WO 2017/062605 | A1 | 4/2017 |
| WO | WO 2017/062723 | A1 | 4/2017 |
| WO | WO 2017/062754 | A1 | 4/2017 |
| WO | WO 2017/062855 | A1 | 4/2017 |
| WO | WO 2017/062886 | A1 | 4/2017 |
| WO | WO 2017/062983 | A1 | 4/2017 |
| WO | WO 2017/064439 | A1 | 4/2017 |
| WO | WO 2017/064546 | A1 | 4/2017 |
| WO | WO 2017/064566 | A2 | 4/2017 |
| WO | WO 2017/066175 | A1 | 4/2017 |
| WO | WO 2017/066497 | A2 | 4/2017 |
| WO | WO 2017/066588 | A2 | 4/2017 |
| WO | WO 2017/066707 | A1 | 4/2017 |
| WO | WO 2017/066781 | A1 | 4/2017 |
| WO | WO 2017/068077 | A1 | 4/2017 |
| WO | WO 2017/068377 | A1 | 4/2017 |
| WO | WO 2017/069829 | A2 | 4/2017 |
| WO | WO 2017/070029 | A1 | 4/2017 |
| WO | WO 2017/070032 | A1 | 4/2017 |
| WO | WO 2017/070169 | A1 | 4/2017 |
| WO | WO 2017/070284 | A1 | 4/2017 |
| WO | WO 2017/070598 | A1 | 4/2017 |
| WO | WO 2017/070605 | A1 | 4/2017 |
| WO | WO 2017/070632 | A2 | 4/2017 |
| WO | WO 2017/070633 | A2 | 4/2017 |
| WO | WO 2017/072590 | A1 | 5/2017 |
| WO | WO 2017/074526 | A1 | 5/2017 |
| WO | WO 2017/074962 | A1 | 5/2017 |
| WO | WO 2017/075261 | A1 | 5/2017 |
| WO | WO 2017/075335 | A1 | 5/2017 |
| WO | WO 2017/075475 | A1 | 5/2017 |
| WO | WO 2017/077135 | A1 | 5/2017 |
| WO | WO 2017/077329 | A2 | 5/2017 |
| WO | WO 2017/078751 | A1 | 5/2017 |
| WO | WO 2017/079400 | A1 | 5/2017 |
| WO | WO 2017/079428 | A1 | 5/2017 |
| WO | WO 2017/079673 | A1 | 5/2017 |
| WO | WO 2017/079724 | A1 | 5/2017 |
| WO | WO 2017/081097 | A1 | 5/2017 |
| WO | WO 2017/081288 | A1 | 5/2017 |
| WO | WO 2017/083368 | A1 | 5/2017 |
| WO | WO 2017/083722 | A1 | 5/2017 |
| WO | WO 2017/083766 | A1 | 5/2017 |
| WO | WO 2017/087395 | A1 | 5/2017 |
| WO | WO 2017/090724 | A1 | 6/2017 |
| WO | WO 2017/091510 | A1 | 6/2017 |
| WO | WO 2017/091630 | A1 | 6/2017 |
| WO | WO 2017/092201 | A1 | 6/2017 |
| WO | WO 2017/093370 | A1 | 6/2017 |
| WO | WO 2017/093969 | A1 | 6/2017 |
| WO | WO 2017/095111 | A1 | 6/2017 |
| WO | WO 2017/096041 | A1 | 6/2017 |
| WO | WO 2017/096237 | A1 | 6/2017 |
| WO | WO 2017/100158 | A1 | 6/2017 |
| WO | WO 2017/100431 | A2 | 6/2017 |
| WO | WO 2017/104404 | A1 | 6/2017 |
| WO | WO 2017/105251 | A1 | 6/2017 |
| WO | WO 2017/105350 | A1 | 6/2017 |
| WO | WO 2017/105991 | A1 | 6/2017 |
| WO | WO 2017/106414 | A1 | 6/2017 |
| WO | WO 2017/106528 | A2 | 6/2017 |
| WO | WO 2017/106537 | A2 | 6/2017 |
| WO | WO 2017/106569 | A1 | 6/2017 |
| WO | WO 2017/106616 | A1 | 6/2017 |
| WO | WO 2017/106657 | A1 | 6/2017 |
| WO | WO 2017/106767 | A1 | 6/2017 |
| WO | WO 2017/109134 | A1 | 6/2017 |
| WO | WO 2017/109757 | A1 | 6/2017 |
| WO | WO 2017/112620 | A1 | 6/2017 |
| WO | WO 2017/115268 | A1 | 7/2017 |
| WO | WO 2017/117395 | A1 | 7/2017 |
| WO | WO 2017/118598 | A1 | 7/2017 |
| WO | WO 2017/118720 | A1 | 7/2017 |
| WO | WO 2017/123609 | A1 | 7/2017 |
| WO | WO 2017/123910 | A1 | 7/2017 |
| WO | WO 2017/124086 | A1 | 7/2017 |
| WO | WO 2017/124100 | A1 | 7/2017 |
| WO | WO 2017/124652 | A1 | 7/2017 |
| WO | WO 2017/126987 | A1 | 7/2017 |
| WO | WO 2017/127807 | A1 | 7/2017 |
| WO | WO 2017/131237 | A1 | 8/2017 |
| WO | WO 2017/132112 | A1 | 8/2017 |
| WO | WO 2017/132580 | A2 | 8/2017 |
| WO | WO 2017/136520 | A1 | 8/2017 |
| WO | WO 2017/136629 | A1 | 8/2017 |
| WO | WO 2017/136794 | A1 | 8/2017 |
| WO | WO 2017/139264 | A1 | 8/2017 |
| WO | WO 2017/139505 | A2 | 8/2017 |
| WO | WO 2017/141173 | A2 | 8/2017 |
| WO | WO 2017/142835 | A1 | 8/2017 |
| WO | WO 2017/142999 | A2 | 8/2017 |
| WO | WO 2017/143042 | A2 | 8/2017 |
| WO | WO 2017/147056 | A1 | 8/2017 |
| WO | WO 2017/147278 | A1 | 8/2017 |
| WO | WO 2017/147432 | A1 | 8/2017 |
| WO | WO 2017/147446 | A1 | 8/2017 |
| WO | WO 2017/147555 | A1 | 8/2017 |
| WO | WO 2017/151444 | A1 | 9/2017 |
| WO | WO 2017/151719 | A1 | 9/2017 |

(56) References Cited

FOREIGN PATENT DOCUMENTS

| | | | |
|---|---|---|---|
| WO | WO 2017/152015 | A1 | 9/2017 |
| WO | WO 2017/155717 | A1 | 9/2017 |
| WO | WO 2017/157422 | A1 | 9/2017 |
| WO | WO 2017/158153 | A1 | 9/2017 |
| WO | WO 2017/160689 | A1 | 9/2017 |
| WO | WO 2017/160752 | A1 | 9/2017 |
| WO | WO 2017/160890 | A1 | 9/2017 |
| WO | WO 2017/161068 | A1 | 9/2017 |
| WO | WO 2017/165826 | A1 | 9/2017 |
| WO | WO 2017/165862 | A1 | 9/2017 |
| WO | WO 2017/172644 | A2 | 10/2017 |
| WO | WO 2017/172645 | A2 | 10/2017 |
| WO | WO 2017/172860 | A1 | 10/2017 |
| WO | WO 2017/173004 | A1 | 10/2017 |
| WO | WO 2017/173054 | A1 | 10/2017 |
| WO | WO 2017/173092 | A1 | 10/2017 |
| WO | WO 2017/174329 | A1 | 10/2017 |
| WO | WO 2017/176529 | A1 | 10/2017 |
| WO | WO 2017/176806 | A1 | 10/2017 |
| WO | WO 2017/178590 | A1 | 10/2017 |
| WO | WO 2017/180694 | A1 | 10/2017 |
| WO | WO 2017/180711 | A1 | 10/2017 |
| WO | WO 2017/180915 | A2 | 10/2017 |
| WO | WO 2017/180926 | A1 | 10/2017 |
| WO | WO 2017/181107 | A2 | 10/2017 |
| WO | WO 2017/181735 | A2 | 10/2017 |
| WO | WO 2017/182468 | A1 | 10/2017 |
| WO | WO 2017/184334 | A1 | 10/2017 |
| WO | WO 2017/184768 | A1 | 10/2017 |
| WO | WO 2017/184786 | A1 | 10/2017 |
| WO | WO 2017/186550 | A1 | 11/2017 |
| WO | WO 2017/189308 | A1 | 11/2017 |
| WO | WO 2017/189336 | A1 | 11/2017 |
| WO | WO 2017/190041 | A1 | 11/2017 |
| WO | WO 2017/190257 | A1 | 11/2017 |
| WO | WO 2017/190664 | A1 | 11/2017 |
| WO | WO 2017/191210 | A1 | 11/2017 |
| WO | WO 2017/191274 | A2 | 11/2017 |
| WO | WO 2017/192172 | A1 | 11/2017 |
| WO | WO 2017/192512 | A2 | 11/2017 |
| WO | WO 2017/192544 | A1 | 11/2017 |
| WO | WO 2017/192573 | A1 | 11/2017 |
| WO | WO 2017/193029 | A2 | 11/2017 |
| WO | WO 2017/193053 | A1 | 11/2017 |
| WO | WO 2017/196768 | A1 | 11/2017 |
| WO | WO 2017/197038 | A1 | 11/2017 |
| WO | WO 2017/197238 | A1 | 11/2017 |
| WO | WO 2017/197301 | A1 | 11/2017 |
| WO | WO 2017/201476 | A1 | 11/2017 |
| WO | WO 2017/205290 | A1 | 11/2017 |
| WO | WO 2017/205423 | A1 | 11/2017 |
| WO | WO 2017/207589 | A1 | 12/2017 |
| WO | WO 2017/208247 | A1 | 12/2017 |
| WO | WO 2017/209809 | A1 | 12/2017 |
| WO | WO 2017/213896 | A1 | 12/2017 |
| WO | WO 2017/213898 | A2 | 12/2017 |
| WO | WO 2017/214460 | A1 | 12/2017 |
| WO | WO 2017/216392 | A1 | 12/2017 |
| WO | WO 2017/216771 | A2 | 12/2017 |
| WO | WO 2017/218185 | A1 | 12/2017 |
| WO | WO 2017/219027 | A1 | 12/2017 |
| WO | WO 2017/219033 | A1 | 12/2017 |
| WO | WO 2017/220751 | A1 | 12/2017 |
| WO | WO 2017/222370 | A1 | 12/2017 |
| WO | WO 2017/222773 | A1 | 12/2017 |
| WO | WO 2017/222834 | A1 | 12/2017 |
| WO | WO 2017/223107 | A1 | 12/2017 |
| WO | WO 2017/223330 | A1 | 12/2017 |
| WO | WO 2018/000657 | A1 | 1/2018 |
| WO | WO 2018/002719 | A1 | 1/2018 |
| WO | WO 2018/005117 | A1 | 1/2018 |
| WO | WO 2018/005289 | A2 | 1/2018 |
| WO | WO 2018/005691 | A1 | 1/2018 |
| WO | WO 2018/005782 | A1 | 1/2018 |
| WO | WO 2018/005873 | A1 | 1/2018 |
| WO | WO 2018/06693 | A1 | 1/2018 |
| WO | WO 2018/009520 | A1 | 1/2018 |
| WO | WO 2018/009562 | A1 | 1/2018 |
| WO | WO 2018/009822 | A1 | 1/2018 |
| WO | WO 2018/013821 | A1 | 1/2018 |
| WO | WO 2018/013932 | A1 | 1/2018 |
| WO | WO 2018/013990 | A1 | 1/2018 |
| WO | WO 2018/014384 | A1 | 1/2018 |
| WO | WO 2018/015444 | A1 | 1/2018 |
| WO | WO 2018/015936 | A2 | 1/2018 |
| WO | WO 2018/017754 | A1 | 1/2018 |
| WO | WO 2018/018979 | A1 | 2/2018 |
| WO | WO 2018/020248 | A1 | 2/2018 |
| WO | WO 2018/021878 | A1 | 2/2018 |
| WO | WO 2018/022480 | A1 | 2/2018 |
| WO | WO 2018/022634 | A1 | 2/2018 |
| WO | WO 2018/025206 | A1 | 2/2018 |
| WO | WO 2018/026723 | A1 | 2/2018 |
| WO | WO 2018/026976 | A1 | 2/2018 |
| WO | WO 2018/027078 | A1 | 2/2018 |
| WO | WO 2018/030608 | A1 | 2/2018 |
| WO | WO 2018/031683 | A1 | 2/2018 |
| WO | WO 2018/035250 | A1 | 2/2018 |
| WO | WO 2018/035300 | A1 | 2/2018 |
| WO | WO 2018/035423 | A1 | 2/2018 |
| WO | WO 2018/035503 | A1 | 2/2018 |
| WO | WO 2018/039145 | A1 | 3/2018 |
| WO | WO 2018/039438 | A1 | 3/2018 |
| WO | WO 2018/039440 | A1 | 3/2018 |
| WO | WO 2018/039448 | A1 | 3/2018 |
| WO | WO 2018/045630 | A1 | 3/2018 |
| WO | WO 2018/048827 | A1 | 3/2018 |
| WO | WO 2018/049073 | A1 | 3/2018 |
| WO | WO 2018/049168 | A1 | 3/2018 |
| WO | WO 2018/051347 | A1 | 3/2018 |
| WO | WO 2018/058064 | A1 | 3/2018 |
| WO | WO 2018/062866 | A2 | 4/2018 |
| WO | WO 2018/064352 | A1 | 4/2018 |
| WO | WO 2018/064371 | A1 | 4/2018 |
| WO | WO 2018/064516 | A1 | 4/2018 |
| WO | WO 2018/067546 | A1 | 4/2018 |
| WO | WO 2018/067846 | A1 | 4/2018 |
| WO | WO 2018/068053 | A2 | 4/2018 |
| WO | WO 2018/069474 | A1 | 4/2018 |
| WO | WO 2018/071623 | A2 | 4/2018 |
| WO | WO 2018/071663 | A1 | 4/2018 |
| WO | WO 2018/071868 | A1 | 4/2018 |
| WO | WO 2018/071892 | A1 | 4/2018 |
| WO | WO 2018/074979 | A1 | 4/2018 |
| WO | WO 2018/079134 | A1 | 5/2018 |
| WO | WO 2018/080573 | A1 | 5/2018 |
| WO | WO 2018/081504 | A1 | 5/2018 |
| WO | WO 2018/081535 | A2 | 5/2018 |
| WO | WO 2018/081728 | A1 | 5/2018 |
| WO | WO 2018/083128 | A2 | 5/2018 |
| WO | WO 2018/083606 | A1 | 5/2018 |
| WO | WO 2018/085288 | A1 | 5/2018 |
| WO | WO 2018/085414 | A1 | 5/2018 |
| WO | WO 2018/086623 | A1 | 5/2018 |
| WO | WO 2018/089664 | A1 | 5/2018 |
| WO | WO 2018/093990 | A1 | 5/2018 |
| WO | WO 2018/098383 | A1 | 5/2018 |
| WO | WO 2018/098480 | A1 | 5/2018 |
| WO | WO 2018/098587 | A1 | 6/2018 |
| WO | WO 2018/099256 | A1 | 6/2018 |
| WO | WO 2018/103686 | A1 | 6/2018 |
| WO | WO 2018/106268 | A1 | 6/2018 |
| WO | WO 2018/107028 | A1 | 6/2018 |
| WO | WO 2018/107103 | A1 | 6/2018 |
| WO | WO 2018/107129 | A1 | 6/2018 |
| WO | WO 2018/108272 | A1 | 6/2018 |
| WO | WO 2018/109101 | A1 | 6/2018 |
| WO | WO 2018/111946 | A1 | 6/2018 |
| WO | WO 2018/111947 | A1 | 6/2018 |
| WO | WO 2018/112336 | A1 | 6/2018 |
| WO | WO 2018/112446 | A2 | 6/2018 |
| WO | WO 2018/119354 | A1 | 6/2018 |
| WO | WO 2018/119359 | A1 | 6/2018 |
| WO | WO 2018/120283 | A1 | 7/2018 |

(56) References Cited

FOREIGN PATENT DOCUMENTS

| | | | |
|---|---|---|---|
| WO | WO 2018/130830 | A1 | 7/2018 |
| WO | WO 2018/135838 | A2 | 7/2018 |
| WO | WO 2018/136396 | A2 | 7/2018 |
| WO | WO 2018/138385 | A1 | 8/2018 |
| WO | WO 2018/142364 | A1 | 8/2018 |
| WO | WO 2018/148246 | A1 | 8/2018 |
| WO | WO 2018/148256 | A1 | 8/2018 |
| WO | WO 2018/148647 | A2 | 8/2018 |
| WO | WO 2018/149418 | A1 | 8/2018 |
| WO | WO 2018/149888 | A1 | 8/2018 |
| WO | WO 2018/149915 | A1 | 8/2018 |
| WO | WO 2018/152197 | A1 | 8/2018 |
| WO | WO 2018/152418 | A1 | 8/2018 |
| WO | WO 2018/154380 | A1 | 8/2018 |
| WO | WO 2018/154387 | A1 | 8/2018 |
| WO | WO 2018/154412 | A1 | 8/2018 |
| WO | WO 2018/154413 | A1 | 8/2018 |
| WO | WO 2018/154418 | A1 | 8/2018 |
| WO | WO 2018/154439 | A1 | 8/2018 |
| WO | WO 2018/154459 | A1 | 8/2018 |
| WO | WO 2018/154462 | A1 | 8/2018 |
| WO | WO 2018/156372 | A1 | 8/2018 |
| WO | WO 2018/161009 | A1 | 9/2018 |
| WO | WO 2018/165504 | A1 | 9/2018 |
| WO | WO 2018/165629 | A1 | 9/2018 |
| WO | WO 2018/170015 | A1 | 9/2018 |
| WO | WO 2018/170340 | A1 | 9/2018 |
| WO | WO 2018/175502 | A2 | 9/2018 |
| WO | WO 2018/176009 | A1 | 9/2018 |
| WO | WO 2018/177351 | A1 | 10/2018 |
| WO | WO 2018/179578 | A1 | 10/2018 |
| WO | WO 2018/183403 | A1 | 10/2018 |
| WO | WO 2018/189184 | A1 | 10/2018 |
| WO | WO 2018/191388 | A1 | 10/2018 |
| WO | WO 2018/195402 | A1 | 10/2018 |
| WO | WO 2018/195545 | A2 | 10/2018 |
| WO | WO 2018/195555 | A1 | 10/2018 |
| WO | WO 2018/197020 | A1 | 11/2018 |
| WO | WO 2018/197495 | A1 | 11/2018 |
| WO | WO 2018/202800 | A1 | 11/2018 |
| WO | WO 2018/204493 | A1 | 11/2018 |
| WO | WO 2018/208755 | A1 | 11/2018 |
| WO | WO 2018/208998 | A1 | 11/2018 |
| WO | WO 2018/209158 | A2 | 11/2018 |
| WO | WO 2018/209320 | A1 | 11/2018 |
| WO | WO 2018/213351 | A1 | 11/2018 |
| WO | WO 2018/213708 | A1 | 11/2018 |
| WO | WO 2018/213726 | A1 | 11/2018 |
| WO | WO 2018/213771 | A1 | 11/2018 |
| WO | WO 2018/213791 | A1 | 11/2018 |
| WO | WO 2018/217852 | A1 | 11/2018 |
| WO | WO 2018/217981 | A1 | 11/2018 |
| WO | WO 2018/218166 | A1 | 11/2018 |
| WO | WO 2018/218188 | A2 | 11/2018 |
| WO | WO 2018/218206 | A1 | 11/2018 |
| WO | WO 2019/005884 | A1 | 1/2019 |
| WO | WO 2019/005886 | A1 | 1/2019 |
| WO | WO 2019/010384 | A1 | 1/2019 |
| WO | WO 2019/023680 | A1 | 1/2019 |
| WO | WO 2019/051097 | A1 | 3/2019 |
| WO | WO 2019/079347 | A1 | 4/2019 |
| WO | WO 2019/084062 | A1 | 5/2019 |
| WO | WO 2019/118949 | A1 | 6/2019 |
| WO | WO 2019/123430 | A1 | 6/2019 |
| WO | WO 2019/139645 | A2 | 7/2019 |
| WO | WO 2019/139951 | A1 | 7/2019 |
| WO | WO 2019/147014 | A1 | 8/2019 |
| WO | WO 2019/226953 | A1 | 11/2019 |
| WO | WO 2019/236566 | A1 | 12/2019 |
| WO | WO 2020/014261 | A1 | 1/2020 |
| WO | WO 2020/028555 | A2 | 2/2020 |
| WO | WO 2020/041751 | A1 | 2/2020 |
| WO | WO 2020/047124 | A1 | 3/2020 |
| WO | WO 2020/051360 | A1 | 3/2020 |
| WO | WO 2020/086908 | A1 | 4/2020 |
| WO | WO 2020/092453 | A1 | 5/2020 |
| WO | WO 2020/102659 | A1 | 5/2020 |
| WO | WO 2020/154500 | A1 | 7/2020 |
| WO | WO 2020/181178 | A1 | 9/2020 |
| WO | WO 2020/181180 | A1 | 9/2020 |
| WO | WO 2020/181193 | A1 | 9/2020 |
| WO | WO 2020/181195 | A1 | 9/2020 |
| WO | WO 2020/181202 | A1 | 9/2020 |
| WO | WO 2020/191153 | A1 | 9/2020 |
| WO | WO 2020/191171 | A1 | 9/2020 |
| WO | WO 2020/191233 | A1 | 9/2020 |
| WO | WO 2020/191234 | A1 | 9/2020 |
| WO | WO 2020/191239 | A1 | 9/2020 |
| WO | WO 2020/191241 | A1 | 9/2020 |
| WO | WO 2020/191242 | A1 | 9/2020 |
| WO | WO 2020/191243 | A1 | 9/2020 |
| WO | WO 2020/191245 | A1 | 9/2020 |
| WO | WO 2020/191246 | A1 | 9/2020 |
| WO | WO 2020/191248 | A1 | 9/2020 |
| WO | WO 2020/191249 | A1 | 9/2020 |
| WO | WO 2020/210751 | A1 | 10/2020 |
| WO | WO 2020/214842 | A1 | 10/2020 |
| WO | WO 2020/236982 | A1 | 11/2020 |
| WO | WO 2021/025750 | A1 | 2/2021 |
| WO | WO 2021/030666 | A1 | 2/2021 |
| WO | WO 2021/072328 | A1 | 4/2021 |
| WO | WO 2021/108717 | A2 | 6/2021 |
| WO | WO 2021/155065 | A1 | 8/2021 |
| WO | WO 2021/158921 | A2 | 8/2021 |
| WO | WO 2021/158995 | A1 | 8/2021 |
| WO | WO 2021/158999 | A1 | 8/2021 |

OTHER PUBLICATIONS

Song et al.,"Delivery of CRISPR/Cas systems for cancer gene therapy and immunotherapy", Advanced Drug Delivery Reviews 168: 150-180 (Year: 2021).*
U.S. Appl. No. 61/874,746, filed Sep. 6, 2013, Liu et al.
U.S. Appl. No. 61/874,682, filed Sep. 6, 2013, Liu et al.
U.S. Appl. No. 61/838,178, filed Jun. 21, 2013, Joung et al.
U.S. Appl. No. 61/837,481, filed Jun. 20, 2013, Cho et al.
U.S. Appl. No. 61/803,599, filed Mar. 20, 2013, Kim et al.
U.S. Appl. No. 61/794,422, filed Mar. 15, 2013, Knight et al.
U.S. Appl. No. 61/761,046, filed Feb. 5, 2013, Knight et al.
U.S. Appl. No. 61/758,624, filed Jan. 30, 2013, Chen et al.
U.S. Appl. No. 61/734,256, filed Dec. 6, 2012, Chen et al.
U.S. Appl. No. 61/717,324, filed Oct. 23, 2012, Cho et al.
U.S. Appl. No. 61/716,256, filed Oct. 19, 2012, Jinek et al.
U.S. Appl. No. 62/357,332, filed Jun. 30, 2016, Liu et al.
U.S. Appl. No. 62/288,661, filed Jan. 29, 2016, Muir et al.
U.S. Appl. No. 17/160,329, filed Jan. 27, 2021, Liu et al.
U.S. Appl. No. 17/130,812, filed Dec. 22, 2020, Liu et al.
U.S. Appl. No. 17/148,059, filed Jan. 13, 2021, Liu et al.
U.S. Appl. No. 16/976,047, filed Aug. 26, 2020, Liu et al.
U.S. Appl. No. 17/289,665, filed Apr. 28, 2021, Liu et al.
U.S. Appl. No. 16/772,747, filed Jun. 12, 2020, Shen et al.
U.S. Appl. No. 17/425,261, filed Jul. 22, 2021, Kim et al.
U.S. Appl. No. 17/259,147, filed Jan. 8, 2021, Liu et al.
U.S. Appl. No. 17/270,396, filed Feb. 22, 2021, Liu et al.
U.S. Appl. No. 17/273,688, filed Mar. 4, 2021, Liu et al.
U.S. Appl. No. 17/288,504, filed Apr. 23, 2021, Liu et al.
U.S. Appl. No. 17/219,590, filed Mar. 31, 2021, Liu et al.
U.S. Appl. No. 17/219,635, filed Mar. 31, 2021, Liu et al.
U.S. Appl. No. 17/219,672, filed Mar. 31, 2021, Liu et al.
U.S. Appl. No. 17/294,287, filed May 14, 2021, Liu et al.
[No Author Listed] "Human genome." Encyclopedia Britannica. Encyclopedia Brittanica, Inc. Published Feb. 15, 2019. Last accessed online via //www-britannica.com/science/human-genome on Mar. 19, 2021. 2 pages.
[No Author Listed] HyPhy—Hypothesis testing using Phylogenies. Last modified Apr. 21, 2017. Accessed online via hyphy.org/w/index.php/Main_Page on Apr. 28, 2021.
[No Author Listed] NCBI Accession No. XP_015843220.1. C→U editing enzyme APOBEC-1 [Peromyscus maniculatus bairdii], XP002793540. Mar. 21, 2016.

(56) References Cited

OTHER PUBLICATIONS

[No Author Listed] NCBI Accession No. XP_021505673.1. C→U editing enzyme APOBEC-1 [Meriones unguiculatus], XP002793541. Jun. 27, 2017.
[No Author Listed] Score result for SEQ 355 to W02017032580. Muir et al. 2016.
[No Author Listed], EMBL Accession No. Q99ZW2. Nov. 2012. 2 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.
[No. Author Listed], Invitrogen Lipofectamine™ LTX product sheets, 2011. 4 pages.
[No Author Listed], Thermo Fisher Scientific—How Cationic Lipid Mediated Transfection Works, retrieved from the internet Aug. 27, 2015. 2 pages.
Abremski et al., Bacteriophage P1 site-specific recombination. Purification and properties of the Cre recombinase protein. J Biol Chem. Feb. 10, 1984;259(3):1509-14.
Abudayyeh et al., C2c2 is a single-component programmable RNA-guided RNA-targeting CRISPR effector. Science Aug. 2016;353(6299):aaf5573. DOI: 10.1126/science.aaf5573.
Abudayyeh et al., A cytosine deaminase for programmable single-base RNA editing. Science. Jul. 26, 2019;365(6451):382-386. doi: 10.1126/science.aax7063. Epub Jul. 11, 2019.
Abudayyeh et al., RNA targeting with CRISPR-Cas13. Nature. Oct. 12, 2017;550(7675):280-284. doi: 10.1038/nature24049. Epub Oct. 4, 2017.
Ada et al., Carbohydrate-protein conjugate vaccines. Clin Microbiol Infect. Feb. 2003;9(2):79-85. doi: 10.1046/j.1469-0691.2003.00530.x.
Adamala et al., Programmable RNA-binding protein composed of repeats of a single modular unit. Proc Natl Acad Sci U S A. May 10, 2016;113(19):E2579-88. doi: 10.1073/pnas.1519368113. Epub Apr. 26, 2016.
Adams et al., New biarsenical ligands and tetracysteine motifs for protein labeling in vitro and in vivo: synthesis and biological applications. J Am Chem Soc. May 29, 2002;124(21):6063-76. doi: 10.1021/ja017687n.
Addgene Plasmid # 44246. pdCas9-humanized, 2017, Stanley Qi.
Addgene Plasmid # 73021. PCMV-BE3, 2017, David Liu.
Addgene Plasmid # 79620. pcDNA3.1_pCMV-nCas-PmCDA1-ugi pH1-gRNA(HPRT), 2017, Akihiko Kondo.
Adli, The CRISPR tool kit for genome editing and beyond. Nat Commun. May 15, 2018;9(1):1911. doi: 10.1038/s41467-018-04252-2.
Aguilo et al., Coordination of m(6)A mRNA Methylation and Gene Transcription by ZFP217 Regulates Pluripotency and Reprogramming. Cell Stem Cell. Dec. 3, 2015;17(6):689-704. doi: 10.1016/j.stem.2015.09.005. Epub Oct. 29, 2015.
AHMAD et al., Antibody-mediated specific binding and cytotoxicity of liposome-entrapped doxorubicin to lung cancer cells in vitro. Cancer Res. Sep. 1, 1992;52(17):4817-20.
Aihara et al., A conformational switch controls the DNA cleavage activity of lambda integrase. Mol Cell. Jul. 2003;12(1):187-98.
Aik et al., Structure of human RNA N?-methyladenine demethylase ALKBH5 provides insights into its mechanisms of nucleic acid recognition and demethylation. Nucleic Acids Res. Apr. 2014;42(7):4741-54. doi: 10.1093/nar/gku085. Epub Jan. 30, 2014.
Aird et al., Increasing Cas9-mediated homology-directed repair efficiency through covalent tethering of DNA repair template. Commun Biol. May 31, 2018;1:54. doi: 10.1038/s42003-018-0054-2.
Akcakaya et al., In vivo CRISPR editing with no detectable genome-wide off-target mutations. Nature. Sep. 2018;561(7723):416-419. doi: 10.1038/s41586-018-0500-9. Epub Sep. 12, 2018. PMID: 30209390; PMCID: PMC6194229.
Akins et al., Mitochondrial plasmids of Neurospora: integration into mitochondrial DNA and evidence for reverse transcription in mitochondria. Cell. Nov. 21, 1986;47(4):505-16. doi: 10.1016/0092-8674(86)90615-x.
Akinsheye et al., Fetal hemoglobin in sickle cell anemia. Blood. Jul. 7, 2011;118(1):19-27. doi: 10.1182/blood-2011-03-325258. Epub Apr. 13, 2011.
Alarcón et al., HNRNPA2B1 Is a Mediator of m(6)A-Dependent Nuclear RNA Processing Events. Cell. Sep. 10, 2015;162(6):1299-308. doi: 10.1016/j.cell.2015.08.011. Epub Aug. 27, 2015.
Alarcón et al., N6-methyladenosine marks primary microRNAs for processing. Nature. Mar. 26, 2015;519(7544):482-5. doi: 10.1038/nature14281. Epub Mar. 18, 2015.
Alexander, HFE-associated hereditary hemochromatosis. Genet Med. May 2009;11(5):307-13. doi: 10.1097/GIM.0b013e31819d30f2.
Alexandrov et al., Signatures of mutational processes in human cancer. Nature. Aug. 22, 2013;500(7463):415-21. doi: 10.1038/nature12477. Epub Aug. 14, 2013.
Ali et al., Novel genetic abnormalities in Bernard-Soulier syndrome in India. Ann Hematol. Mar. 2014;93(3):381-4. doi: 10.1007/s00277-013-1895-x. Epub Sep. 1, 2013.
Altschul et al., Basic local alignment search tool. J Mol Biol. Oct. 5, 1990;215(3):403-10. doi: 10.1016/S0022-2836(05)80360-2.
Amato et al., Interpreting elevated fetal hemoglobin in pathology and health at the basic laboratory level: new and known ?-gene mutations associated with hereditary persistence of fetal hemoglobin. Int J Lab Hematol. Feb. 2014;36(1):13-9. doi: 10.1111/ijlh.12094. Epub Apr. 29, 2013.
Ames et al., A eubacterial riboswitch class that senses the coenzyme tetrahydrofolate. Chem Biol. Jul. 30, 2010;17(7):681-5. doi: 10.1016/j.chembiol.2010.05.020.
Amrann et al., Tightly regulated tac promoter vectors useful for the expression of unfused and fused proteins in *Escherichia coli*. Gene. Sep. 30, 1988;69(2):301-15.
Anders et al., Chapter One: In Vitro Enzymology of Cas9. in Methods in Enzymology, eds Doudna et al. 2014: 546:1-20.
Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.
Anderson, Human gene therapy. Science. May 8, 1992;256(5058):808-13. doi: 10.1126/science.1589762.
Anzalone et al., Reprogramming eukaryotic translation with ligand-responsive synthetic RNA switches. Nat Methods. May 2016;13(5):453-8. doi: 10.1038/nmeth.3807. Epub Mar. 21, 2016.
Anzalone et al., Search-and-replace genome editing without double-strand breaks or donor DNA. Nature. Dec. 2019;576(7785):149-157. doi: 10.1038/s41586-019-1711-4. Epub Oct. 21, 2019.
Aplan, Causes of oncogenic chromosomal translocation. Trends Genet. Jan. 2006;22(1):46-55. doi: 10.1016/j.tig.2005.10.002. Epub Oct. 28, 2005.
Arakawa et al., A method to convert mRNA into a gRNA library for CRISPR/Cas9 editing of any organism. Sci Adv. Aug. 24, 2016;2(8):e1600699. doi: 10.1126/sciadv.1600699.
Araki et al., Comparative analysis of right element mutant lox sites on recombination efficiency in embryonic stem cells. BMC Biotechnol. Mar. 31, 2010;10:29. doi: 10.1186/1472-6750-10-29.
Araki et al., Site-specific recombinase, R, encoded by yeast plasmid pSR1. J Mol Biol. May 5, 1992;225(1):25-37. doi: 10.1016/0022-2836(92)91023-i.
Araki et al., Targeted integration of DNA using mutant lox sites in embryonic stem cells. Nucleic Acids Res. Feb. 15, 1997;25(4):868-72. doi: 10.1093/nar/25.4.868.
Arambula et al., Surface display of a massively variable lipoprotein by a Legionella diversity-generating retroelement. Proc Natl Acad Sci U S A. May 14, 2013;110(20):8212-7. doi: 10.1073/pnas.1301366110. Epub Apr. 30, 2013.
Arazoe et al., Targeted Nucleotide Editing Technologies for Microbial Metabolic Engineering. Biotechnol J. Sep. 2018;13(9):e1700596. doi: 10.1002/biot.201700596. Epub Jun. 19, 2018.
Arbab et al., Cloning-free CRISPR. Stem Cell Reports. Nov. 10, 2015;5(5):908-917. doi: 10.1016/j.stemcr.2015.09.022. Epub Oct. 29, 2015.

(56) References Cited

OTHER PUBLICATIONS

Arezi et al., Novel mutations in Moloney Murine Leukemia Virus reverse transcriptase increase thermostability through tighter binding to template-primer. Nucleic Acids Res. Feb. 2009;37(2):473-81. doi: 10.1093/nar/gkn952. Epub Dec. 4, 2008.
Arnold et al., Mutants of Tn3 resolvase which do not require accessory binding sites for recombination activity. Embo J. Mar. 1, 1999;18(5):1407-14.
Asante et al., A naturally occurring variant of the human prion protein completely prevents prion disease. Nature. Jun. 25, 2015;522(7557):478-81. doi: 10.1038/nature14510. Epub Jun. 10, 2015.
Atkins et al., Ribosomal frameshifting and transcriptional slippage: From genetic steganography and cryptography to adventitious use. Nucleic Acids Res. Sep. 6, 2016;44(15):7007-78. doi: 10.1093/nar/gkw530. Epub Jul. 19, 2016.
Auer et al., Highly efficient CRISPR/Cas9-mediated knock-in in zebrafish by homology-independent DNA repair. Genome Res. Jan. 2014;24(1):142-53. doi: 10.1101/gr.161638.113. Epub Oct. 31, 2013.
Autieri et al., IRT-1, a novel interferon-gamma-responsive transcript encoding a growth-suppressing basic leucine zipper protein. J Biol Chem. Jun. 12, 1998;273(24):14731-7. doi: 10.1074/jbc.273.24.14731.
Avidan et al., The processivity and fidelity of DNA synthesis exhibited by the reverse transcriptase of bovine leukemia virus. Eur J Biochem. Feb. 2002;269(3):859-67. doi: 10.1046/j.0014-2956.2001.02719.x.
Babacic et al., CRISPR-cas gene-editing as plausible treatment of neuromuscular and nucleotide-repeat-expansion diseases: A systematic review. PLoS One. Feb. 22, 2019;14(2):e0212198. doi: 10.1371/journal.pone.0212198.
Bacman et al., Specific elimination of mutant mitochondrial genomes in patient-derived cells by mitoTALENs. Nat Med. Sep. 2013;19(9):1111-3. doi: 10.1038/nm.3261. Epub Aug. 4, 2013.
Badran et al., Continuous evolution of Bacillus thuringiensis toxins overcomes insect resistance. Nature. May 5, 2016;533(7601):58-63. doi: 10.1038/nature17938. Epub Apr. 27, 2016.
Badran et al., Development of potent in vivo mutagenesis plasmids with broad mutational spectra. Nat Commun. Oct. 7, 2015;6:8425. doi: 10.1038/ncomms9425.
Bae et al., Microhomology-based choice of Cas9 nuclease target sites. Nat Methods. Jul. 2014;11(7):705-6. doi: 10.1038/nmeth.3015.
Bagyinszky et al., Characterization of mutations in PRNP (prion) gene and their possible roles in neurodegenerative diseases. Neuropsychiatr Dis Treat. Aug. 14, 2018;14:2067-2085. doi: 10.2147/NDT.S165445.
Balakrishnan et al., Flap endonuclease 1. Annu Rev Biochem. 2013;82:119-38. doi: 10.1146/annurev-biochem-072511-122603. Epub Feb. 28, 2013.
Baldari et al., A novel leader peptide which allows efficient secretion of a fragment of human interleukin 1 beta in *Saccharomyces cerevisiae*. Embo J. Jan. 1987;6(1):229-34.
Banerjee et al., Cadmium inhibits mismatch repair by blocking the ATPase activity of the MSH2-MSH6 complex [published correction appears in Nucleic Acids Res. 2005;33(5):1738]. Nucleic Acids Res. 2005;33(4):1410-1419. Published Mar. 3, 2005. doi:10.1093/nar/gki291.
Banerji et al., A lymphocyte-specific cellular enhancer is located downstream of the joining region in immunoglobulin heavy chain genes. Cell. Jul. 1983;33(3):729-40. doi: 10.1016/0092-8674(83)90015-6.
Bannert et al., Retroelements and the human genome: new perspectives on an old relation. Proc Natl Acad Sci U S A. Oct. 5, 2004;101 Suppl 2(Suppl 2):14572-9. doi: 10.1073/pnas.0404838101. Epub Aug. 13, 2004.
Baranauskas et al., Generation and characterization of new highly thermostable and processive M-MuLV reverse transcriptase variants. Protein Eng Des Sel. Oct. 2012;25(10):657-68. doi: 10.1093/protein/gzs034. Epub Jun. 12, 2012.
Barnes et al., Repair and genetic consequences of endogenous DNA base damage in mammalian cells. Annu Rev Genet. 2004;38:445-76.
Barnes et al., The fidelity of Taq polymerase catalyzing PCR is improved by an N-terminal deletion. Gene. Mar. 1, 1992;112(1):29-35. doi: 10.1016/0378-1119(92)90299-5.
Barrangou et al., CRISPR provides acquired resistance against viruses in prokaryotes. Science. Mar. 23, 2007;315(5819):1709-12.
Barrangou, RNA-mediated programmable DNA cleavage. Nat Biotechnol. Sep. 2012;30(9):836-8. doi: 10.1038/nbt.2357.
Bartlett et al., Efficient expression of protein coding genes from the murine U1 small nuclear RNA promoters. Proc Natl Acad Sci U S A. Aug. 20, 1996;93(17):8852-7. doi: 10.1073/pnas.93.17.8852.
Bartosovic et al., N6-methyladenosine demethylase FTO targets pre-mRNAs and regulates alternative splicing and 3'-end processing. Nucleic Acids Res. Nov. 2, 2017;45(19):11356-11370. doi: 10.1093/nar/gkx778.
Basha et al., Influence of cationic lipid composition on gene silencing properties of lipid nanoparticle formulations of siRNA in antigen-presenting cells. Mol Ther. Dec. 2011;19(12):2186-200. doi: 10.1038/mt.2011.190. Epub Oct. 4, 2011.
Basturea et al., Substrate specificity and properties of the *Escherichia coli* 16S rRNA methyltransferase, RsmE. RNA. Nov. 2007;13(11):1969-76. doi: 10.1261/rna.700507. Epub Sep. 13, 2007.
Batey et al., Structure of a natural guanine-responsive riboswitch complexed with the metabolite hypoxanthine. Nature. Nov. 18, 2004;432(7015):411-5.
Beale et al., Comparison of the differential context-dependence of DNA deamination by APOBEC enzymes: correlation with mutation spectra in vivo. J Mol Biol. Mar. 26, 2004;337(3):585-96.
Bebenek et al., Error-prone polymerization by HIV-1 reverse transcriptase. Contribution of template-primer misalignment, miscoding, and termination probability to mutational hot spots. J Biol Chem. May 15, 1993;268(14):10324-34.
Bedell et al., In vivo genome editing using a high-efficiency TALEN system. Nature. Nov. 1, 2012;491(7422):114-8. Doi: 10.1038/nature11537. Epub Sep. 23, 2012.
Begley, Scientists unveil the 'most clever CRISPR gadget' so far. STAT, Apr. 20, 2016. https://www.statnews.com/2016/04/20/clever-crispr-advance-unveiled/.
Behr, Gene transfer with synthetic cationic amphiphiles: prospects for gene therapy. Bioconjug Chem. Sep.-Oct. 1994;5(5):382-9. doi: 10.1021/bc00029a002.
Belshaw et al., Controlling programmed cell death with a cyclophilin-cyclosporin-based chemical inducer of dimerization. Chem Biol. Sep. 1996;3(9):731-8. doi: 10.1016/s1074-5521(96)90249-5.
Belshaw et al., Controlling protein association and subcellular localization with a synthetic ligand that induces heterodimerization of proteins. Proc Natl Acad Sci U S A. May 14, 1996;93(10):4604-7. doi: 10.1073/pnas.93.10.4604.
Bennett et al., Painful and painless channelopathies. Lancet Neurol. Jun. 2014;13(6):587-99. doi: 10.1016/S1474-4422(14)70024-9. Epub May 6, 2014.
Berger et al., Reverse transcriptase and its associated ribonuclease H: interplay of two enzyme activities controls the yield of single-stranded complementary deoxyribonucleic acid. Biochemistry. May 10, 1983;22(10):2365-72. doi: 10.1021/bi00279a010.
Berkhout et al., Identification of an active reverse transcriptase enzyme encoded by a human endogenous HERV-K retrovirus. J Virol. Mar. 1999;73(3):2365-75. doi: 10.1128/JVI.73.3.2365-2375.1999.
Bernhart et al., Local RNA base pairing probabilities in large sequences. Bioinformatics. Mar. 1, 2006;22(5):614-5. doi: 10.1093/bioinformatics/btk014. Epub Dec. 20, 2005.
Bernstein et al., Role for a bidentate ribonuclease in the initiation step of RNA interference. Nature. Jan. 18, 2001;409(6818):363-6. doi: 10.1038/35053110.
Bershtein et al., Advances in laboratory evolution of enzymes. Curr Opin; Chem Biol. Apr. 2008;12(2):151-8. doi: 10.1016/j.cbpa.2008.01.027. Epub Mar. 7, 2008. Review.
Bertolotti et al., Toward genosafe endonuclease-boosted gene targeting using breakthrough CRISP/Cas9 for next generation stem cell gene therapy culminating in efficient ex VIVO in VIVO gene

(56) References Cited

OTHER PUBLICATIONS repair/genomic editing. Molecular Therapy. May 2015;23(Suppl1):S139. Abstract 350. 18th Ann Meeting of the American Society of Gene and Cell Therapy. ASGCT 2015. New Orleans, LA. May 13, 2015-May 16, 2015.
Bertrand et al., Localization of ASH1 mRNA particles in living yeast. Mol Cell. Oct. 1998;2(4):437-45. doi: 10.1016/s1097-2765(00)80143-4.
Bessen et al., High-resolution specificity profiling and off-target prediction for site-specific DNA recombinases. Nat Commun. Apr. 26, 2019;10(1):1937. doi: 10.1038/s41467-019-09987-0.
Beumer et al., Efficient gene targeting in *Drosophila* with zinc-finger nucleases. Genetics. Apr. 2006;172(4):2391-403. Epub Feb. 1, 2006.
Bi et al., Pseudo attP sites in favor of transgene integration and expression in cultured porcine cells identified by Streptomyces phage phiC31 integrase. BMC Mol Biol. Sep. 8, 2013;14:20. doi: 10.1186/1471-2199-14-20.
Bibb et al., Integration and excision by the large serine recombinase phiRv1 integrase. Mol Microbiol. Mar. 2005;55(6):1896-910. doi: 10.1111/j.1365-2958.2005.04517.x.
Biehs et al., DNA Double-Strand Break Resection Occurs during Non-homologous End Joining in G1 but Is Distinct from Resection during Homologous Recombination. Mol Cell. Feb. 16, 2017;65(4):671-684.e5. doi: 10.1016/j.molcel.2016.12.016. Epub Jan. 26, 2017.
Billon et al., CRISPR-Mediated Base Editing Enables Efficient Disruption of Eukaryotic Genes through Induction of STOP Codons. Mol Cell. Sep. 21, 2017;67(6):1068-1079.e4. doi: 10.1016/j.molcel.2017.08.008. Epub Sep. 7, 2017.
Birling et al., Site-specific recombinases for manipulation of the mouse genome. Methods Mol Biol. 2009;561:245-63. doi: 10.1007/978-1-60327-019-9_16.
Biswas et al., A structural basis for allosteric control of DNA recombination by lambda integrase. Nature. Jun. 23, 2005;435(7045):1059-66. doi: 10.1038/nature03657.
Bitinaite et al., FokI dimerization is required for DNA cleavage. Proc Natl Acad Sci U S A. Sep. 1, 1998;95(18):10570-5.
Blaese et al., Vectors in cancer therapy: how will they deliver? Cancer Gene Ther. Dec. 1995;2(4):291-7.
Blain et al., Nuclease activities of Moloney murine leukemia virus reverse transcriptase. Mutants with altered substrate specificities. J Biol Chem. Nov. 5, 1993;268(31):23585-92.
Blaisonneau et al., A circular plasmid from the yeast *Torulaspora delbrueckii*. Plasmid. 1997;38(3):202-9. doi: 10.1006/plas.1997.1315.
Blau et al., A proliferation switch for genetically?modified?cells. PNAS Apr. 1, 1997 94 (7) 3076-3081; https://doi.org/10.1073/pnas.94.7.3076.
Bloom et al., Evolving strategies for enzyme engineering. Curr Opin Struct Biol. Aug. 2005;15(4):447-52.
Boch, TALEs of genome targeting. Nat Biotechnol. Feb. 2011;29(2):135-6. Doi: 10.1038/nbt.1767.
Böck et al., Selenocysteine: the 21st amino acid. Mol Microbiol. Mar. 1991;5(3):515-20.
Bodi et al., Yeast m6A Methylated mRNAs Are Enriched on Translating Ribosomes during Meiosis, and under Rapamycin Treatment. PLoS One. Jul. 17, 2015;10(7):e0132090. doi: 10.1371/journal.pone.0132090.
Boeckle et al., Melittin analogs with high lytic activity at endosomal pH enhance transfection with purified targeted PEI polyplexes. J Control Release. May 15, 2006;112(2):240-8. Epub Mar. 20, 2006.
Boersma et al., Selection strategies for improved biocatalysts. Febs J. May 2007;274(9):2181-95.
Bogdanove et al., Engineering altered protein-DNA recognition specificity. Nucleic Acids Res. Jun. 1, 2018;46(10):4845-4871. doi: 10.1093/nar/gky289.
Bogdanove et al., TAL effectors: customizable proteins for DNA targeting. Science. Sep. 30, 2011;333(6051):1843-6. doi: 10.1126/science.1204094.
Bohlke et al., Sense codon emancipation for proteome-wide incorporation of noncanonical amino acids: rare isoleucine codon AUA as a target for genetic code expansion. FEMS Microbiol Lett. Feb. 2014;351(2):133-44. doi: 10.1111/1574-6968.12371. Epub Jan. 27, 2014.
Bolotin et al., Clustered regularly interspaced short palindrome repeats (CRISPRs) have spacers of extrachromosomal origin. Microbiology. Aug. 2005;151(Pt 8):2551-61.
Bolusani et al., Evolution of variants of yeast site-specific recombinase Flp that utilize native genomic sequences as recombination target sites. Nucleic Acids Res. 2006;34(18):5259-69. Epub Sep. 26, 2006.
Bondeson et al., Inversion of the IDS gene resulting from recombination with IDS-related sequences is a common cause of the Hunter syndrome. Hum Mol Genet. Apr. 1995;4(4):615-21. doi: 10.1093/hmg/4.4.615.
Borchardt et al., Controlling mRNA stability and translation with the CRISPR endoribonuclease Csy4. RNA. Nov. 2015;21(11):1921-30. doi: 10.1261/rna.051227.115. Epub Sep. 9, 2015.
Borman, Improved route to single-base genome editing. Chemical & Engineering News, Apr. 25, 2016;94(17)p5. http://cen.acs.org/articles/94/il7/Improved-route-single-base-genome.html.
Boutabout et al., DNA synthesis fidelity by the reverse transcriptase of the yeast retrotransposon Ty1. Nucleic Acids Res. Jun. 1, 2001;29(11):2217-22. doi: 10.1093/nar/29.11.2217.
Box et al., A multi-domain protein system based on the HC fragment of tetanus toxin for targeting DNA to neuronal cells. J Drug Target. Jul. 2003;11(6):333-43. doi: 10.1080/10611863100016346 67.
Branden and Tooze, Introduction to Protein Structure. 1999; 2nd edition. Garland Science Publisher: 3-12.
Braun et al., Immunogenic duplex nucleic acids are nuclease resistant. J Immunol. Sep. 15, 1988;141(6):2084-9.
Briner et al., Guide RNA functional modules direct Cas9 activity and orthogonality. Mol Cell. Oct. 23, 2014;56(2):333-339. doi: 10.1016/j.molcel.2014.09.019.
Britt et al., Re-engineering plant gene targeting. Trends Plant Sci. Feb. 2003;8(2):90-5.
Brouns et al., Small CRISPR RNAs guide antiviral defense in prokaryotes. Science. Aug. 15, 2008;321(5891):960-4. doi: 10.1126/science.1159689.
Brown et al., Serine recombinases as tools for genome engineering. Methods. Apr. 2011;53(4):372-9. doi: 10.1016/j.ymeth.2010.12.031. Epub Dec. 30, 2010.
Brown et al., A mammalian protein targeted by G1-arresting rapamycin-receptor complex. Nature. Jun. 30, 1994;369(6483):756-8. doi: 10.1038/369756a0.
Brown et al., Characterization of the genetic elements required for site-specific integration of plasmid pSE211 in Saccharopolyspora erythraea. J Bacteriol. Apr. 1990;172(4):1877-88. doi: 10.1128/jb.172.4.1877-1888.1990.
Brown et al., Structural insights into the stabilization of MALAT1 noncoding RNA by a bipartite triple helix. Nat Struct Mol Biol. Jul. 2014;21(7):633-40. doi: 10.1038/nsmb.2844. Epub Jun. 22, 2014.
Brusse et al., Spinocerebellar ataxia associated with a mutation in the fibroblast growth factor 14 gene (SCA27): A new phenotype. Mov Disord. Mar. 2006;21(3):396-401.
Brzezicha et al., Identification of human tRNA:m5C methyltransferase catalysing intron-dependent m5C formation in the first position of the anticodon of the pre-tRNA Leu (CAA). Nucleic Acids Res. 2006;34(20):6034-43. doi: 10.1093/nar/gkl765. Epub Oct. 27, 2006.
Buchholz et al., Alteration of Cre recombinase site specificity by substrate-linked protein evolution. Nat Biotechnol. Nov. 2001;19(11):1047-52.
Buchschacher et al., Human immunodeficiency virus vectors for inducible expression of foreign genes. J Virol. May 1992;66(5):2731-9. doi: 10.1128/JVI.66.5.2731-2739.1992.
Buchwald et al., Long-term, continuous intravenous heparin administration by an implantable infusion pump in ambulatory patients with recurrent venous thrombosis. Surgery. Oct. 1980;88(4):507-16.
Buckley et al., Targeting the von Hippel-Lindau E3 ubiquitin ligase using small molecules to disrupt the VHL/HIF-1? interaction. J Am Chem Soc. Mar. 14, 2012;134(10):4465-8. doi: 10.1021/ja209924v. Epub Feb. 27, 2012.

(56) References Cited

OTHER PUBLICATIONS

Budisa et al., Residue-specific bioincorporation of non-natural, biologically active amino acids into proteins as possible drug carriers: structure and stability of the per-thiaproline mutant of annexin V. Proc Natl Acad Sci U S A. Jan. 20, 1998;95(2):455-9.
Budker et al., Protein/amphipathic polyamine complexes enable highly efficient transfection with minimal toxicity. Biotechniques. Jul. 1997;23(1):139, 142-7. doi: 10.2144/97231rr02.
Budworth et al., A brief history of triplet repeat diseases. Methods Mol Biol. 2013;1010:3-17. doi: 10.1007/978-1-62703-411-1_1.
Bulow et al., Multienzyme systems obtained by gene fusion. Trends Biotechnol. Jul. 1991;9(7):226-31.
Burke et al., RNA Aptamers to the Adenosine Moiety of S-adenosyl Methionine: Structural Inferences From Variations on a Theme and the Reproducibility of SELEX. Nucleic Acids Res. May 15, 1997;25(10):2020-4. doi: 10.1093/nar/25.10.2020.
Burstein et al., New CRISPR-Cas systems from uncultivated microbes. Nature Feb. 2017;542(7640):237-240.
Buskirk et al., In vivo evolution of an RNA-based transcriptional activator. Chem Biol. Jun. 2003;10(6):533-40. doi: 10.1016/s1074-5521(03)00109-l.
Buskirk et al., Directed evolution of ligand dependence: small-molecule-activated protein splicing. Proc Natl Acad Sci U S A. Jul. 20, 2004;101(29):10505-10. Epub Jul. 9, 2004.
Byrne et al., Multiplex gene regulation: a two-tiered approach to transgene regulation in transgenic mice. Proc Natl Acad Sci U S A. Jul. 1989;86(14):5473-7. doi: 10.1073/pnas.86.14.5473.
Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.
Cadwell et al., Randomization of genes by PCR mutagenesis. PCR Methods Appl. Aug. 1992;2(1):28-33. doi: 10.1101/gr.2.1.28.
Cai et al., Reconstruction of ancestral protein sequences and its applications. BMC Evol Biol. Sep. 17, 2004;4:33. doi: 10.1186/1471-2148-4-33.
Calame et al., Transcriptional controlling elements in the immunoglobulin and T cell receptor loci. Adv Immunol. 1988;43:235-75. doi: 10.1016/s0065-2776(08)60367-3.
Caldecott et al., Single-strand break repair and genetic disease. Nat Rev Genet. Aug. 2008;9(8):619-31. doi: 10.1038/nrg2380.
Camarero et al., Biosynthesis of a Head-to-Tail Cyclized Protein with Improved Biological Activity. J. Am. Chem. Soc. May 29, 1999; 121(23):5597-5598. https://doi.org/10.1021/ja990929n.
Cameron, Recent advances in transgenic technology. Mol Biotechnol. Jun. 1997;7(3):253-65.
Camper et al., Postnatal repression of the alpha-fetoprotein gene is enhancer independent. Genes Dev. Apr. 1989;3(4):537-46. doi: 10.1101/gad.3.4.537.
Camps et al., Targeted gene evolution in *Escherichia coli* using a highly error-prone DNA polymerase I. Proc Natl Acad Sci U S A. Aug. 19, 2003;100(17):9727-32. Epub Aug. 8, 2003.
Canchaya et al., Genome analysis of an inducible prophage and prophage remnants integrated in the *Streptococcus pyogenes* strain SF370. Virology. Oct. 25, 2002;302(2):245-58. doi: 10.1006/viro.2002.1570.
Canver et al., Customizing the genome as therapy for the ?-hemoglobinopathies. Blood. May 26, 2016;127(21):2536-45. doi: 10.1182/blood-2016-01-678128. Epub Apr. 6, 2016.
Cargill et al. Characterization of single-nucleotide polymorphisms in coding regions of human genes. Nat Genet. Jul. 1999;22(3):231-8.
Carlier et al., Burkholderia cenocepacia H111 Rhy-family protein. Apr. 16, 2015. Retrieved from the Internet via https://www.ebi.ac.uk/ena/browser/api/embl/CDN65395.1?lineLimit=1000. Last retrieved Apr. 26, 2021.
Carlson et al., Negative selection and stringency modulation in phage-assisted continuous evolution. Nat Chem Biol. Mar. 2014;10(3):216-22. doi: 10.1038/nchembio.1453. Epub Feb. 2, 2014. With Supplementary Results.
Caron et al., Intracellular delivery of a Tat-eGFP fusion protein into muscle cells. Mol Ther. Mar. 2001;3(3):310-8.
Carr et al., Genome engineering. Nat Biotechnol. Dec. 2009;27(12):1151-62. doi: 10.1038/nbt.1590.
Carroll et al., Gene targeting in *Drosophila* and Caenorhabditis elegans with zinc-finger nucleases. Methods Mol Biol. 2008;435:63-77. doi: 10.1007/978-1-59745-232-8_5.
Carroll et al., Progress and prospects: zinc-finger nucleases as gene therapy agents. Gene Ther. Nov. 2008;15(22):1463-8. doi: 10.1038/gt.2008.145. Epub Sep. 11, 2008.
Carroll, A CRISPR approach to gene targeting. Mol Ther. Sep. 2012;20(9):1658-60. doi: 10.1038/mt.2012.171.
Carroll, Genome engineering with zinc-finger nucleases. Genetics. Aug. 2011;188(4):773-82. doi: 10.1534/genetics.111.131433. Review.
Carvalho et al., Evolution in health and medicine Sackler colloquium: Genomic disorders: a window into human gene and genome evolution. Proc Natl Acad Sci U S A. Jan. 26, 2010;107 Suppl 1(Suppl 1):1765-71. doi: 10.1073/pnas.0906222107. Epub Jan. 13, 2010.
Caspi et al., Distribution of split DnaE inteins in cyanobacteria. Mol Microbiol. Dec. 2003;50(5):1569-77. doi: 10.1046/j.1365-2958.2003.03825.x.
Cattaneo et al., SEL1L affects human pancreatic cancer cell cycle and invasiveness through modulation of PTEN and genes related to cell-matrix interactions. Neoplasia. 2005;7(11):1030-1038.
Ceccaldi et al., Repair Pathway Choices and Consequences at the Double-Strand Break. Trends Cell Biol. Jan. 2016;26(1):52-64. doi: 10.1016/j.tcb.2015.07.009. Epub Oct. 1, 2015.
Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.
Chadalavada et al., Wild-type is the optimal sequence of the HDV ribozyme under cotranscriptional conditions. RNA. Dec. 2007;13(12):2189-201. doi: 10.1261/rna.778107. Epub Oct. 23, 2007.
Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.
Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.
Chalberg et al., Integration specificity of phage phiC31 integrase in the human genome. J Mol Biol. Mar. 17, 2006;357(1):28-48. doi: 10.1016/j.jmb.2005.11.098. Epub Dec. 22, 2005.
Chalberg et al., phiC31 integrase confers genomic integration and long-term transgene expression in rat retina. Invest Ophthalmol Vis Sci. Jun. 2005;46(6):2140-6. doi: 10.1167/iovs.04-1252.
Chan et al., Molecular recording of mammalian embryogenesis. Nature. Jun. 2019;570(7759):77-82. doi: 10.1038/s41586-019-1184-5. Epub May 13, 2019.
Chan et al., Novel selection methods for DNA-encoded chemical libraries. Curr Opin Chem Biol. 2015;26:55-61. doi:10.1016/j.cbpa.2015.02.010.
Chan et al., The choice of nucleotide inserted opposite abasic sites formed within chromosomal DNA reveals the polymerase activities participating in translesion DNA synthesis. DNA Repair (Amst). Nov. 2013;12(11):878-89. doi: 10.1016/j.dnarep.2013.07.008. Epub Aug. 26, 2013.
Chapman et al., Playing the end game: DNA double-strand break repair pathway choice. Mol Cell. Aug. 24, 2012;47(4):497-510. doi: 10.1016/j.molcel.2012.07.029.
Charpentier et al., Biotechnology: Rewriting a genome. Nature. Mar. 7, 2013;495(7439):50-1. doi: 10.1038/495050a.
Chaturvedi et al., Stabilization of triple-stranded oligonucleotide complexes: use of probes containing alternating phosphodiester and stereo-uniform cationic phosphoramidate linkages. Nucleic Acids Res. Jun. 15, 1996;24(12):2318-23.
Chavez et al., Highly efficient Cas9-mediated transcriptional programming. Nat Methods. Apr. 2015;12(4):326-8. doi: 10.1038/nmeth.3312. Epub Mar. 2, 2015.

(56) References Cited

OTHER PUBLICATIONS

Chavez et al., Precise Cas9 targeting enables genomic mutation prevention. bioRxiv. Jun. 14, 2016; http://dx/doi.oreg/10.1101/058974. 6 pages.
Chavez et al., Precise Cas9 targeting enables genomic mutation prevention. Proc Natl Acad Sci U S A. Apr. 3, 2018;115(14):3669-3673. doi: 10.1073/pnas.1718148115. Epub Mar. 19, 2018. bioRxiv preprint first posted online Jun. 14, 2016.
Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.
Chelico et al., Stochastic properties of processive cytidine DNA deaminases AID and APOBEC3G. Philos Trans R Soc Lond B Biol Sci. Mar. 12, 2009;364(1517):583-93. doi: 10.1098/rstb.2008.0195.
Chen et al., Enhanced proofreading governs CRISPR-Cas9 targeting accuracy. Nature. Oct. 19, 2017;550(7676):407-410. doi: 10.1038/nature24268. Epub Sep. 20, 2017.
Chen et al., A general strategy for the evolution of bond-forming enzymes using yeast display. Proc Natl Acad Sci U S A. Jul. 12, 2011;108(28):11399-404. doi: 10.1073/pnas.1101046108. Epub Jun. 22, 2011.
Chen et al., Fusion protein linkers: property, design and functionality. Adv Drug Deliv Rev. Oct. 2013;65(10):1357-69. doi: 10.1016/j.addr.2012.09.039. Epub Sep. 29, 2012.
Chen et al., Highly Efficient Mouse Genome Editing by CRISPR Ribonucleoprotein Electroporation of Zygotes. J Biol Chem. Jul. 8, 2016;291(28):14457-67. doi: 10.1074/jbc.M116.733154. Epub May 5, 2016.
Chen et al., m(6)A RNA methylation is regulated by microRNAs and promotes reprogramming to pluripotency. Cell Stem Cell. Mar. 5, 2015;16(3):289-301. doi: 10.1016/j.stem.2015.01.016. Epub Feb. 12, 2015.
Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.
Chesnoy et al., Structure and function of lipid-DNA complexes for gene delivery. Annu Rev Biophys Biomol Struct. 2000;29:27-47.
Chew et al., A multifunctional AAV-CRISPR-Cas9 and its host response. Nat Methods. Oct. 2016;13(10):868-74. doi: 10.1038/nmeth.3993. Epub Sep. 5, 2016.
Chew et al., A multifunctional AAV-CRISPR-Cas9 and its host response. Nat Methods. Oct. 2016;13(10):868-74. doi: 10.1038/nmeth.3993. Epub Sep. 5, 2016. Supplementary Information.
Chichili et al., Linkers in the structural biology of protein-protein interactions. Protein Science. 2013;22:153-67.
Chin, Expanding and reprogramming the genetic code of cells and animals. Annu Rev Biochem. 2014;83:379-408. doi: 10.1146/annurev-biochem-060713-035737. Epub Feb. 10, 2014.
Chipev et al., A leucine-proline mutation in the H1 subdomain of keratin 1 causes epidermolytic hyperkeratosis. Cell. Sep. 4, 1992;70(5):821-8.
Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.
Cho et al., Site-specific recombination of bacteriophage P22 does not require integration host factor. J Bacteriol. Jul. 1999;181(14):4245-9. doi: 10.1128/JB.181.14.4245-4249.1999.
Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.
Choe et al., Forging Ahead through Darkness: PCNA, Still the Principal Conductor at the Replication Fork. Mol Cell. Feb. 2, 2017;65(3):380-392. doi: 10.1016/j.molcel.2016.12.020.
Choi et al., N(6)-methyladenosine in mRNA disrupts tRNA selection and translation-elongation dynamics. Nat Struct Mol Biol. Feb. 2016;23(2):110-5. doi: 10.1038/nsmb.3148. Epub Jan. 11, 2016.
Choi et al., Protein trans-splicing and characterization of a split family B-type DNA polymerase from the hyperthermophilic archaeal parasite *Nanoarchaeum equitans*. J Mol Biol. Mar. 10, 2006;356(5):1093-106. doi: 10.1016/j.jmb.2005.12.036. Epub Dec. 27, 2005.
CHOI et at al., Translesion synthesis across abasic lesions by human B-family and Y-family DNA polymerases α, δ, η, τ, κ, and Rev1. J Mol Biol. Nov. 19, 2010;404(1):34-44. doi: 10.1016/j.jmb.2010.09.015. Epub Oct. 1, 2010.
Chong et al., Modulation of protein splicing of the *Saccharomyces cerevisiae* vacuolar membrane ATPase intein. J Biol Chem. Apr. 24, 1998;273(17):10567-77. doi: 10.1074/jbc.273.17.10567.
Chong et al., Utilizing the C-terminal cleavage activity of a protein splicing element to purify recombinant proteins in a single chromatographic step. Nucleic Acids Res. Nov. 15, 1998;26(22):5109-15. doi: 10.1093/nar/26.22.5109.
Chong et al., Protein splicing involving the *Saccharomyces cerevisiae* VMA intein. The steps in the splicing pathway, side reactions leading to protein cleavage, and establishment of an in vitro splicing system. J Biol Chem. Sep. 6, 1996;271(36):22159-68. doi: 10.1074/jbc.271.36.22159.
Chong et al., Protein splicing of the *Saccharomyces cerevisiae* VMA intein without the endonuclease motifs. J Biol Chem. Jun. 20, 1997;272(25): 15587-90. doi: 10.1074/jbc.272.25.15587.
Chong et al., Single-column purification of free recombinant proteins using a self-cleavable affinity tag derived from a protein splicing element. Gene. Jun. 19, 1997;192(2):271-81. doi: 10.1016/s0378-1119(97)00105-4.
Choudhury et al., Engineering RNA endonucleases with customized sequence specificities. Nat Commun. 2012;3:1147. doi: 10.1038/ncomms2154.
Choulika et al., Induction of homologous recombination in mammalian chromosomes by using the I-SceI system of *Saccharomyces cerevisiae*. Mol Cell Biol. Apr. 1995;15(4):1968-73. doi: 10.1128/MCB.15.4.1968.
Christian et al, Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.
Christian et al., Targeting DNA double-strand breaks with TAL effector nucleases. Genetics. Oct. 2010;186(2):757-61. Doi: 10.1534/genetics.110.120717. Epub Jul. 26, 2010.
Christiansen et al., Characterization of the lactococcal temperate phage TP901-1 and its site-specific integration. J Bacteriol. Feb. 1994;176(4):1069-76. doi: 10.1128/jb.176.4.1069-1076.1994.
Chu et al., Increasing the efficiency of homology-directed repair for CRISPR-Cas9-induced precise gene editing in mammalian cells. Nat Biotech. Feb. 13, 2015;33:543-8. doi: 10.1038/nbt.3198. Epub Mar. 24, 2015.
Chuai et al., DeepCRISPR: optimized CRISPR guide RNA design by deep learning. Genome Biol. Jun. 26, 2018;19(1):80. doi: 10.1186/s13059-018-1459-4.
Chuai et al., In Silico Meets In Vivo: Towards Computational CRISPR-Based sgRNA Design. Trends Biotechnol. Jan. 2017;35(1):12-21. doi: 10.1016/j.tibtech.2016.06.008. Epub Jul. 11, 2016.
Chuang et al., Novel Heterotypic Rox Sites for Combinatorial Dre Recombination Strategies. G3 (Bethesda). Dec. 29, 2015;6(3):559-71. doi: 10.1534/g3.115.025841.
Chujo et al., Trmt61B is a methyltransferase responsible for 1-methyladenosine at position 58 of human mitochondrial tRNAs. RNA. Dec. 2012;18(12):2269-76. doi: 10.1261/rna.035600.112. Epub Oct. 24, 2012.
Chung-Il et al., Artificial control of gene expression in mammalian cells by modulating RNA interference through aptamer-small molecule interaction. RNA. May 2006;12(5):710-6. Epub Apr. 10, 2006.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Clackson et al., Redesigning an FKBP-ligand interface to generate chemical dimerizers with novel specificity. Proc Natl Acad Sci U S A. Sep. 1, 1998;95(18):10437-42. doi: 10.1073/pnas.95.18.10437.

(56) References Cited

OTHER PUBLICATIONS

Clement et al., CRISPResso2 provides accurate and rapid genome editing sequence analysis. Nat Biotechnol. Mar. 2019;37(3):224-226. doi: 10.1038/s41587-019-0032-3.
Cobb et al., Directed evolution as a powerful synthetic biology tool. Methods. Mar. 15, 2013;60(1):81-90. doi: 10.1016/j.ymeth.2012.03.009. Epub Mar. 23, 2012.
Cokol et al., Finding nuclear localization signals. EMBO Rep. Nov. 2000;1(5):411-5. doi: 10.1093/embo-reports/kvd092.
Cole et al., Reconstructing evolutionary adaptive paths for protein engineering. Methods Mol Biol. 2013;978:115-25. doi: 10.1007/978-1-62703-293-3_8.
COLE-Strauss et al., Correction of the mutation responsible for sickle cell anemia by an RNA-DNA oligonucleotide. Science. Sep. 6, 1996;273(5280):1386-9.
Collinge, Prion diseases of humans and animals: their causes and molecular basis. Annu Rev Neurosci. 2001;24:519-50. doi: 10.1146/annurev.neuro.24.1.519.
Cong et al., Multiplex genome engineering using CRISPR/Cas systems. Science. Feb. 15, 2013;339(6121):819-23. doi: 10.1126/science.1231143. Epub Jan. 3, 2013.
Conrad et al., A Kaposi's sarcoma virus RNA element that increases the nuclear abundance of intronless transcripts. Embo J. May 18, 2005;24(10):1831-41. doi: 10.1038/sj.emboj.7600662. Epub Apr. 28, 2005.
Conticello, The AID/APOBEC family of nucleic acid mutators. Genome Biol. 2008;9(6):229. doi: 10.1186/gb-2008-9-6-229. Epub Jun. 17, 2008.
Cornu et al., Refining strategies to translate genome editing to the clinic. Nat Med. Apr. 3, 2017;23(4):415-423. doi: 10.1038/nm.4313.
Costa et al., Frequent use of the same tertiary motif by self-folding RNAs. EMBO J. Mar. 15, 1995;14(6):1276-85.
Cotton et al., Insertion of a Synthetic Peptide into a Recombinant Protein Framework:? A Protein Biosensor. J. Am. Chem. Soc. Jan. 22, 1999; 121(5):1100-1. https://doi.org/10.1021/ja983804b.
Covino et al., The CCL2/CCR2 Axis in the Pathogenesis of HIV-1 Infection: A New Cellular Target for Therapy? Current Drug Targets Dec. 2016;17(1):76-110. DOI: 10.2174/138945011701151217110917.
Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.
Cox et al., RNA editing with CRISPR-Cas13. Science. Nov. 24, 2017;358(6366):1019-1027. doi: 10.1126/science.aaq0180. Epub Oct. 25, 2017.
Cox et al., Therapeutic genome editing: prospects and challenges. Nat Med. Feb. 2015;21(2):121-31. doi: 10.1038/nm.3793.
Cox, Proteins pinpoint double strand breaks. Elife. Oct. 29, 2013;2:e01561. doi: 10.7554/eLife.01561.
Crabtree et al., Three-part inventions: intracellular signaling and induced proximity. Trends Biochem Sci. Nov. 1996;21(11):418-22. doi: 10.1016/s0968-0004(96)20027-1.
Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.
Cradick et al., ZFN-site searches genomes for zinc finger nuclease target sites and off-target sites. BMC Bioinformatics. May 13, 2011;12:152. doi: 10.1186/1471-2105-12-152.
Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.
Crick, On protein synthesis. Symp Soc Exp Biol. 1958;12:138-63.
Crystal, Transfer of genes to humans: early lessons and obstacles to success. Science. Oct. 20, 1995;270(5235):404-10. doi: 10.1126/science.270.5235.404.
Cui et al., Consequences of Cas9 cleavage in the chromosome of *Escherichia coli*. Nucleic Acids Res. May 19, 2016;44(9):4243-51. doi: 10.1093/nar/gkw223. Epub Apr. 8, 2016.
Cui et al., m6A RNA Methylation Regulates the Self-Renewal and Tumorigenesis of Glioblastoma Stem Cells. Cell Rep. Mar. 14, 2017;18(11):2622-2634. doi: 10.1016/j.celrep.2017.02.059.
Cui et al., Review of CRISPR/Cas9 sgRNA Design Tools. Interdiscip Sci. Jun. 2018;10(2):455-465. doi: 10.1007/s12539-018-0298-z. Epub Apr. 11, 2018.
Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.
Cunningham et al., Ensembl 2015. Nucleic Acids Res. Jan. 2015;43(Database issue):D662-9. doi: 10.1093/nar/gku1010. Epub Oct. 28, 2014.
Cupples et al., A set of lacZ mutations in *Escherichia coli* that allow rapid detection of each of the six base substitutions. Proc Natl Acad Sci U S A. Jul. 1989;86(14):5345-9.
D'Adda di Fagagna et al., The Gam protein of bacteriophage Mu is an orthologue of eukaryotic Ku. EMBO Rep. Jan. 2003;4(1):47-52.
Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.
Dahlgren et al., A novel mutation in ribosomal protein S4 that affects the function of a mutated RF1. Biochimie. Aug. 2000;82(8):683-91.
Dahlman et al., Orthogonal gene knockout and activation with a catalytically active Cas9 nuclease. Nat Biotechnol. Nov. 2015;33(11):1159-61. doi: 10.1038/nbt.3390.
Dandage et al., beditor: A Computational Workflow for Designing Libraries of Guide RNAs for CRISPR-Mediated Base Editing. Genetics. Jun. 2019;212(2):377-385. doi: 10.1534/genetics.119.302089. Epub Apr. 1, 2019.
Dang et al., Optimizing sgRNA structure to improve CRISPR-Cas9 knockout efficiency. Genome Biol. Dec. 15, 2015;16:280. doi: 10.1186/s13059-015-0846-3.
Das et al.,The crystal structure of the monomeric reverse transcriptase from Moloney murine leukemia virus. Structure. May 2004;12(5):819-29. doi: 10.1016/j.str.2004.02.032.
Dassa et al., Fractured genes: a novel genomic arrangement involving new split inteins and a new homing endonuclease family. Nucleic Acids Res. May 2009;37(8):2560-73. doi: 10.1093/nar/gkp095. Epub Mar. 5, 2009.
Dassa et al., Trans protein splicing of cyanobacterial split inteins in endogenous and exogenous combinations. Biochemistry. Jan. 9, 2007;46(1):322-30. doi: 10.1021/bi0611762.
Datsenko et al., One-step inactivation of chromosomal genes in *Escherichia coli* K-12 using PCR products. Proc Natl Acad Sci U S A. Jun. 6, 2000;97(12):6640-5.
Davis et al., DNA double strand break repair via non-homologous end-joining. Transl Cancer Res. Jun. 2013;2(3):130-143.
Davis et al., Small molecule-triggered Cas9 protein with improved genome-editing specificity. Nat Chem Biol. May 2015;11(5):316-8. doi: 10.1038/nchembio.1793. Epub Apr. 6, 2015.
De Felipe et al., Co-translational, intraribosomal cleavage of polypeptides by the foot-and-mouth disease virus 2A peptide. J Biol Chem. Mar. 28, 2003;278(13):11441-8. doi: 10.1074/jbc.M211644200. Epub Jan. 8, 2003.
De Souza, Primer: genome editing with engineered nucleases. Nat Methods. Jan. 2012;9(1):27.
De Wit et al., The Human CD4+ T Cell Response against Mumps Virus Targets a Broadly Recognized Nucleoprotein Epitope. J Virol. Mar. 5, 2019;93(6):e01883-18. doi: 10.1128/JVI.01883-18.
Dean et al., Genetic restriction of HIV-1 infection and progression to AIDS by a deletion allele of the CKR5 structural gene. Hemophilia Growth and Development Study, Multicenter AIDS Cohort Study, Multicenter Hemophilia Cohort Study, San Francisco City Cohort, ALIVE Study. Science. Sep. 27, 1996;273(5283):1856-62. doi: 10.1126/science.273.5283.1856.
DeKosky et al., Large-scale sequence and structural comparisons of human naive and antigen-experienced antibody repertoires. Proc Natl Acad Sci U S A. May 10, 2016;113(19):E2636-45. doi: 10.1073/pnas.1525510113. Epub Apr. 25, 2016.

(56) References Cited

OTHER PUBLICATIONS

Delebecque et al., Organization of intracellular reactions with rationally designed RNA assemblies. Science. Jul. 22, 2011;333(6041):470-4. doi: 10.1126/science.1206938. Epub Jun. 23, 2011.
Deltcheva et al., Crispr RNA maturation by trans-encoded small RNA and host factor RNase III. Nature. Mar. 31, 2011;471(7340):602-7. doi: 10.1038/nature09886.
Deng et al., Widespread occurrence of N6-methyladenosine in bacterial mRNA. Nucleic Acids Res. Jul. 27, 2015;43(13):6557-67. doi: 10.1093/nar/gkv596. Epub Jun. 11, 2015.
Deriano et al., Modernizing the nonhomologous end-joining repertoire: alternative and classical NHEJ share the stage. Annu Rev Genet. 2013;47:433-55. doi: 10.1146/annurev-genet-110711-155540. Epub Sep. 11, 2013.
Deussing, Targeted mutagenesis tools for modelling psychiatric disorders. Cell Tissue Res. Oct. 2013;354(1):9-25. doi: 10.1007/s00441-013-1708-5. Epub Sep. 10, 2013.
Dever et al., CRISPR/Cas9 ?-globin gene targeting in human haematopoietic stem cells. Nature. Nov. 17, 2016;539(7629):384-389. doi: 10.1038/nature20134. Epub Nov. 7, 2016.
Dianov et al., Mammalian base excision repair: the forgotten archangel. Nucleic Acids Res. Apr. 1, 2013;41(6):3483-90. doi: 10.1093/nar/gkt076. Epub Feb. 13, 2013.
Dicarlo et al., Genome engineering in *Saccharomyces cerevisiae* using CRISPR-Cas systems. Nucleic Acids Research Apr. 2013;41(7):4336-43.
Dicarlo et al., Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.
Dicarlo et al., Safeguarding CRISPR-Cas9 gene drives in yeast. Nat Biotechnol. Dec. 2015;33(12):1250-1255. doi: 10.1038/nbt.3412. Epub Nov. 16, 2015.
Dickey et al., Single-stranded DNA-binding proteins: multiple domains for multiple functions. Structure. Jul. 2, 2013;21(7):1074-84. doi: 10.1016/j.str.2013.05.013.
Dickinson et al., Experimental interrogation of the path dependence and stochasticity of protein evolution using phage-assisted continuous evolution. Proc Natl Acad Sci U S A. May 2013;110(22):9007-12.
Dillon, Regulating gene expression in gene therapy. Trends Biotechnol. May 1993;11(5):167-73. doi: 10.1016/0167-7799(93)90109-M.
Ding et al., A Talen genome-editing system for generating human stem cell-based disease models. Cell Stem Cell. Feb. 7, 2013;12(2):238-51. Doi: 10.1016/j.stem.2012.11.011. Epub Dec. 13, 2012.
Ding et al., Permanent alteration of PCSK9 with in vivo CRISPR-Cas9 genome editing. Circ Res. Aug. 15, 2014;115(5):488-92. doi: 10.1161/CIRCRESAHA.115.304351. Epub Jun. 10, 2014.
Dingwall et al., Nuclear targeting sequences—a consensus? Trends Biochem Sci. Dec. 1991;16(12):478-81. doi: 10.1016/0968-0004(91)90184-w.
Diver et al., Single-Step Synthesis of Cell-Permeable Protein Dimerizers That Activate Signal Transduction and Gene Expression. J. Am. Chem. Soc. Jun. 4, 1997;119(22):5106-5109. https://doi.org/10.1021/ja963891c.
Dixon et al., Reengineering orthogonally selective riboswitches. Proc Natl Acad Sci U S A. Feb. 16, 2010;107(7):2830-5. doi: 10.1073/pnas.0911209107. Epub Jan. 26, 2010.
Doench et al., Optimized sgRNA design to maximize activity and minimize off-target effects of CRISPR-Cas9. Nat Biotechnol. Feb. 2016;34(2):184-191. doi: 10.1038/nbt.3437.
Doman et al., Evaluation and minimization of Cas9-independent off-target DNA editing by cytosine base editors. Nat Biotechnol. May 2020;38(5):620-628. doi: 10.1038/s41587-020-0414-6. Epub Feb. 10, 2020.
Dominissini et al., Topology of the human and mouse m6A RNA methylomes revealed by m6A-seq. Nature. Apr. 29, 2012;485(7397):201-6. doi: 10.1038/nature11112.
Dorgan et al., An enzyme-coupled continuous spectrophotometric assay for S-adenosylmethionine-dependent methyltransferases. Anal Biochem. Mar. 15, 2006;350(2):249-55. doi: 10.1016/j.ab.2006.01.004. Epub Feb. 7, 2006.
Dormiani et al., Long-term and efficient expression of human ?-globin gene in a hematopoietic cell line using a new site-specific integrating non-viral system. Gene Ther. Aug. 2015;22(8):663-74. doi: 10.1038/gt.2015.30. Epub Apr. 1, 2015.
Dorr et al., Reprogramming the specificity of sortase enzymes. Proc Natl Acad Sci U S A. Sep. 16, 2014;111(37):13343-8. doi: 10.1073/pnas.1411179111. Epub Sep. 3, 2014.
Doudna et al., Genome editing. The new frontier of genome engineering with CRISPR-Cas9. Science. Nov. 28, 2014;346(6213):1258096. doi: 10.1126/science.1258096.
Dove et al., Conversion of the omega subunit of *Escherichia coli* RNA polymerase into a transcriptional activator or an activation target. Genes Dev. Mar. 1, 1998;12(5):745-54.
Doyon et al., Directed evolution and substrate specificity profile of homing endonuclease I-SceI. J Am Chem Soc. Feb. 22, 2006;128(7):2477-84.
Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.
Drake, A constant rate of spontaneous mutation in DNA-based microbes. Proc Natl Acad Sci U S A. Aug. 15, 1991;88(16):7160-4.
Dubois et al., Retroviral RNA Dimerization: From Structure to Functions. Front Microbiol. Mar. 22, 2018;9:527. doi: 10.3389/fmicb.2018.00527.
Dumas et al., Designing logical codon reassignment—Expanding the chemistry in biology. Chem Sci. Jan. 1, 2015;6(1):50-69. doi: 10.1039/c4sc01534g. Epub Jul. 14, 2014. Review.
Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.
Dunbar et al., Gene therapy comes of age. Science. Jan. 12, 2018;359(6372):eaan4672. doi: 10.1126/science.aan4672.
Dupuy et al., Le syndrome de De La Chapelle [De La Chapelle syndrome]. Presse Med. Mar. 3, 2001;30(8):369-72. French.
Durai et al., A bacterial one-hybrid selection system for interrogating zinc finger-DNA interactions. Comb Chem High Throughput Screen. May 2006;9(4):301-11.
Durai et al., Zinc finger nucleases: custom-designed molecular scissors for genome engineering of plant and mammalian cells. Nucleic Acids Res. Oct. 26, 2005;33(18):5978-90. doi: 10.1093/nar/gki912.
During et al., Controlled release of dopamine from a polymeric brain implant: in vivo characterization. Ann Neurol. Apr. 1989;25(4):351-6.
East-Seletsky et al., Two distinct RNase activities of CRISPR-C2c2 enable guide-RNA processing and RNA detection. Nature Oct. 2016;538(7624):270-3.
Edlund et al., Cell-specific expression of the rat insulin gene: evidence for role of two distinct 5' flanking elements. Science. Nov. 22, 1985;230(4728):912-6. doi: 10.1126/science.3904002.
Edwards et al., An *Escherichia coli* tyrosine transfer RNA is a leucine-specific transfer RNA in the yeast *Saccharomyces cerevisiae*. Proc Natl Acad Sci U S A. Feb. 15, 1991;88(4):1153-6.
Edwards et al., Crystal structures of the thi-box riboswitch bound to thiamine pyrophosphate analogs reveal adaptive RNA-small molecule recognition. Structure. Sep. 2006;14(9):1459-68.
Eick et al., Robustness of Reconstructed Ancestral Protein Functions to Statistical Uncertainty. Mol Biol Evol. Feb. 1, 2017;34(2):247-261. doi: 10.1093/molbev/msw223.
Eiler et al., Structural Basis for the Fast Self-Cleavage Reaction Catalyzed by the Twister Ribozyme. Proc Natl Acad Sci U S A. Sep. 9, 2014;111(36): 13028-33. doi: 10.1073/pnas.1414571111. Epub Aug. 25, 2014.
Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.

(56) References Cited

OTHER PUBLICATIONS

Endo et al., Toward establishing an efficient and versatile gene targeting system in higher plants. Biocatalysis and Agricultural Biotechnology 2014;3,(1):2-6.
Engel et al., The emerging role of mRNA methylation in normal and pathological behavior. Genes Brain Behav. Mar. 2018;17(3):e12428. doi: 10.1111/gbb.12428. Epub Nov. 17, 2017.
Engelward et al., Base excision repair deficient mice lacking the Aag alkyladenine DNA glycosylase. Proc Natl Acad Sci U S A. Nov. 25, 1997;94(24):13087-92.
England, Unnatural amino acid mutagenesis: a precise tool for probing protein structure and function. Biochemistry. Sep. 21, 2004;43(37):11623-9.
Enyeart et al., Biotechnological applications of mobile group II introns and their reverse transcriptases: gene targeting, RNA-seq, and non-coding RNA analysis. Mobile DNA 5, 2 (2014). https://doi.org/10.1186/1759-8753-5-2. https://doi.org/10.1186/1759-8753-5-2.
Eriksson et al., Recurrent de novo point mutations in lamin A cause Hutchinson-Gilford progeria syndrome. Nature. May 15, 2003;423(6937):293-8. doi: 10.1038/nature01629. Epub Apr. 25, 2003. PMID: 12714972.
Esvelt et al., A system for the continuous directed evolution of biomolecules. Nature. Apr. 28, 2011;472(7344):499-503. doi: 10.1038/nature09929. Epub Apr. 10, 2011.
Esvelt et al., Genome-scale engineering for systems and synthetic biology. Mol Syst Biol. 2013;9:641. doi: 10.1038/msb.2012.66.
Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.
Evans et al., Protein trans-splicing and cyclization by a naturally split intein from the dnaE gene of *Synechocystis* species PCC6803. J Biol Chem. Mar. 31, 2000;275(13):9091-4. doi: 10.1074/jbc.275.13.9091.
Evans et al., Semisynthesis of cytotoxic proteins using a modified protein splicing element. Protein Sci. Nov. 1998;7(11):2256-64. doi: 10.1002/pro.5560071103.
Evans et al., The cyclization and polymerization of bacterially expressed proteins using modified self-splicing inteins. J Biol Chem. Jun. 25, 1999;274(26):18359-63. doi: 10.1074/jbc.274.26.18359.
Evans et al., The in vitro ligation of bacterially expressed proteins using an intein from Methanobacterium thermoautotrophicum. J Biol Chem. Feb. 12, 1999;274(7):3923-6. doi: 10.1074/jbc.274.7.3923.
Evers et al., CRISPR knockout screening outperforms shRNA and CRISPRi in identifying essential genes. Nat Biotechnol. Jun. 2016;34(6):631-3. doi: 10.1038/nbt.3536. Epub Apr. 25, 2016.
Fagerlund et al., The Cpf1 CRISPR-Cas protein expands genome-editing tools. Genome Biology Nov. 17, 2015;16:251. https://doi.org/10.1186/s13059-015-0824-9.
Falnes et al., DNA repair by bacterial AlkB proteins. Res Microbiol. Oct. 2003;154(8):531-8. doi: 10.1016/S0923-2508(03)00150-5.
Falnes et al., Repair of methyl lesions in DNA and RNA by oxidative demethylation. Neuroscience. Apr. 14, 2007;145(4):1222-32. doi: 10.1016/j.neuroscience.2006.11.018. Epub Dec. 18, 2006.
Fang et al., Synthetic Studies Towards Halichondrins: Synthesis of the Left Halves of Norhalichondrins and Homohalichondrins. Tetrahedron Letters 1992;33(12):1557-1560.
Farhood et al., Codelivery to mammalian cells of a transcriptional factor with cis-acting element using cationic liposomes. Anal Biochem. Feb. 10, 1995;225(1):89-93.
Fawcett et al., Transposable elements controlling I-R hybrid dysgenesis in *D. melanogaster* are similar to mammalian LINEs. Cell. Dec. 26, 1986;47(6):1007-15. doi: 10.1016/0092-8674(86)90815-9.
Feldstein et al., Two sequences participating in the autolytic processing of satellite tobacco ringspot virus complementary RNA. Gene. Oct. 15, 1989;82(1):53-61. doi: 10.1016/0378-1119(89)90029-2.
Felletti et al., Twister Ribozymes as Highly Versatile Expression Platforms for Artificial Riboswitches. Nat Commun. Sep. 27, 2016;7:12834. doi: 10.1038/ncomms12834.
Feng et al., Crystal structures of the human RNA demethylase Alkbh5 reveal basis for substrate recognition. J Biol Chem. Apr. 25, 2014;289(17):11571-11583. doi: 10.1074/jbc.M113.546168. Epub Mar. 10, 2014.
Feng et al., Human L1 retrotransposon encodes a conserved endonuclease required for retrotransposition. Cell. Nov. 29, 1996;87(5):905-16. doi: 10.1016/s0092-8674(00)81997-2.
Ferretti et al., Complete genome sequence of an M1 strain of *Streptococcus pyogenes*. Proc Natl Acad Sci U S A. Apr. 10, 2001;98(8):4658-63.
Ferry et al., Rational design of inducible CRISPR guide RNAs for de novo assembly of transcriptional programs. Nat Commun. Mar. 3, 2017;8:14633. doi: 10.1038/ncomms14633.
Feuk, Inversion variants in the human genome: role in disease and genome architecture. Genome Med. Feb. 12, 2010;2(2):11. doi: 10.1186/gm132.
Filippov et al., A novel type of RNase III family proteins in eukaryotes. Gene. Mar. 7, 2000;245(1):213-21. doi: 10.1016/s0378-1119(99)00571-5.
Fine et al., Trans-spliced Cas9 allows cleavage of HBB and CCR5 genes in human cells using compact expression cassettes. Scientific Reports 2015;5(1):Article No. 10777. doi:10.1038/srep10777. With Supplementary Information.
Fire et al., Potent and specific genetic interference by double-stranded RNA in Caenorhabditis elegans. Nature. Feb. 19, 1998;391(6669):806-11. doi: 10.1038/35888.
Fischbach et al., Directed evolution can rapidly improve the activity of chimeric assembly-line enzymes. Proc Natl Acad Sci U S A. Jul. 17, 2007;104(29):11951-6. doi: 10.1073/pnas.0705348104. Epub Jul. 9, 2007.
Fischer et al., Cryptic epitopes induce high-titer humoral immune response in patients with cancer. J Immunol. Sep. 1, 2010;185(5):3095-102. doi: 10.4049/jimmunol.0902166. Epub Jul. 26, 2010.
Fitzjohn, Diversitree: comparative phylogenetic analyses of diversification in R. Methods in Evology and Evolution. Dec. 2012;3(6):1084-92 .doi: 10.1111/j.2041-210X.2012.00234.x.
Flajolet et al., Woodchuck hepatitis virus enhancer I and enhancer II are both involved in N-myc2 activation in woodchuck liver tumors. J Virol. Jul. 1998;72(7):6175-80. doi: 10.1128/JVI.72.7.6175-6180.1998.
Flaman et al., A rapid PCR fidelity assay. Nucleic Acids Res. Aug. 11, 1994;22(15):3259-60. doi: 10.1093/nar/22.15.3259.
Flynn et al., CRISPR-mediated genotypic and phenotypic correction of a chronic granulomatous disease mutation in human iPS cells. Exp Hematol. Oct. 2015;43(10):838-848.e3. doi: 10.1016/j.exphem.2015.06.002. Epub Jun. 19, 2015. Including supplementary figures and data.
Fogg et al., New applications for phage integrases. J Mol Biol. Jul. 29, 2014;426(15):2703-16. doi: 10.1016/j.jmb.2014.05.014. Epub May 22, 2014.
Fogg et al., Genome Integration and Excision by a New Streptomyces Bacteriophage, ?Joe. Appl Environ Microbiol. Feb. 15, 2017;83(5):e02767-16. doi: 10.1128/AEM.02767-16.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013.
Forster et al., Self-cleavage of virusoid RNA is performed by the proposed 55-nucleotide active site. Cell. Jul. 3, 1987;50(1):9-16. doi: 10.1016/0092-8674(87)90657-x.
Fortini et al., Different DNA polymerases are involved in the short- and long-patch base excision repair in mammalian cells. Biochemistry. Mar. 17, 1998;37(11):3575-80. doi: 10.1021/bi972999h.
Fouts et al., Sequencing Bacillus anthracis typing phages gamma and cherry reveals a common ancestry. J Bacteriol. May 2006;188(9):3402-8. doi: 10.1128/JB.188.9.3402-3408.2006.
Freitas et al., Mechanisms and signals for the nuclear import of proteins. Curr Genomics. Dec. 2009;10(8):550-7. doi: 10.2174/138920209789503941.

(56) References Cited

OTHER PUBLICATIONS

Freshney, Culture of Animal Cells. A Manual of Basic Technique. Alan R. Liss, Inc. New York. 1983;4.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fu et al., Promises and Pitfalls of Intracellular Delivery of Proteins. Bioconjugate Chemistry. Aug. 2014;25:1602-8.
Fuchs et al., Polyarginine as a multifunctional fusion tag. Protein Sci. Jun. 2005; 14(6):1538-44.
Fujisawa et al., Disease-associated mutations in CIAS1 induce cathepsin B-dependent rapid cell death of human THP-1 monocytic cells. Blood. Apr. 1, 2007;109(7):2903-11.
Fukui et al., DNA Mismatch Repair in Eukaryotes and Bacteria. J Nucleic Acids. Jul. 27, 2010;2010. pii: 260512. doi: 10.4061/2010/260512.
Fung et al., Repair at single targeted DNA double-strand breaks in pluripotent and differentiated human cells. PLoS One. 2011;6(5):e20514. doi: 10.1371/journal.pone.0020514. Epub May 25, 2011.
Furukawa et al., In vitro selection of allosteric ribozymes that sense the bacterial second messenger c-di-GMP. Methods Mol Biol. 2014;1111:209-20. doi: 10.1007/978-1-62703-755-6_15.
Gaj et al., 3rd. Genome engineering with custom recombinases. Methods Enzymol. 2014;546:79-91. doi: 10.1016/B978-0-12-801185-0.00004-0.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gajula, Designing an Elusive CoG?GoC CRISPR Base Editor. Trends Biochem Sci. Feb. 2019;44(2):91-94. doi: 10.1016/j.tibs.2018.10.004. Epub Nov. 13, 2018.
Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.
GAO et al., Cationic liposome-mediated gene transfer. Gene Ther. Dec. 1995;2(10):710-22.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gao et al., Self-processing of ribozyme-flanked RNAs into guide RNAs in vitro and in vivo for CRISPR-mediated genome editing. J Integr Plant Biol. Apr. 2014;56(4):343-9. doi: 10.1111/jipb.12152. Epub Mar. 6, 2014.
Gao et al., Treatment of autosomal dominant hearing loss by in vivo delivery of genome editing agents. Nature. Jan. 11, 2018;553(7687):217-221. doi: 10.1038/nature25164. Epub Dec. 20, 2017.
Gapinske et al., CRISPR-SKIP: programmable gene splicing with single base editors. Genome Biol. Aug. 15, 2018;19(1):107. doi: 10.1186/s13059-018-1482-5.
Garcia et al., Transglycosylation: a mechanism for RNA modification (and editing?). Bioorg Chem. Jun. 2005;33(3):229-51. doi: 10.1016/j.bioorg.2005.01.001. Epub Feb. 23, 2005.
Gardlik et al., Vectors and delivery systems in gene therapy. Med Sci Monit. Apr. 2005;11(4):RA110-21. Epub Mar. 24, 2005.
Garibyan et al., Use of the rpoB gene to determine the specificity of base substitution mutations on the *Escherichia coli* chromosome. DNA Repair (Amst). May 13, 2003;2(5):593-608.
Garneau et al., The CRISPR/Cas bacterial immune system cleaves bacteriophage and plasmid DNA. Nature. Nov. 4, 2010;468(7320):67-71. doi: 10.1038/nature09523.
Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.
Gaudelli et al., Programmable base editing of AoT to GoC in genomic DNA without DNA cleavage. Nature. Nov. 23, 2017;551(7681):464-471. doi: 10.1038/nature24644. Epub Oct. 25, 2017. Erratum in: Nature. May 2, 2018.
Gearing, Addgene blog. CRISPR 101: Cas9 nickase design and homology directed repair. 2018. pages 1-12. https://blog.addgene.org/crispr-101-cas9-nickase-design-and-homlogy-directed-repair. Last retrieved online Jun. 25, 2021.
Gehrke et al., An APOBEC3A-Cas9 base editor with minimized bystander and off-target activities. Nat Biotechnol. Nov. 2018;36(10):977-982. doi: 10.1038/nbt.4199. Epub Jul. 30, 2018.
GenBank Accession No. J01600.1. Brooks et al., *E.coli* dam gene coding for DNA adenine methylase. Apr. 26, 1993.
GenBank Accession No. U07651.1. Lu, *Escherichia coli* K12 negative regulator of replication initiation (seqA) gene, complete cds. Jul. 19, 1994.
GenBank Submission; NIH/NCBI Accession No. NM_006027.4. Umar et al., Apr. 10, 2021. 7 pages.
GenBank Submission; NIH/NCBI, Accession No. AAA66622.1. Martinelli et al., May 18, 1995. 2 pages.
GenBank Submission; NIH/NCBI, Accession No. AGT42196. Farzadfar et al., Nov. 2, 2013. 2 pages.
GenBank Submission; NIH/NCBI, Accession No. APG80656.1. Burstein et al., Dec. 10, 2016. 1 pages.
GenBank Submission; NIH/NCBI, Accession No. AYD60528.1. Ram et al., Oct. 2, 2018. 1 page.
GenBank Submission; NIH/NCBI, Accession No. J04623. Kita et al., Apr. 26, 1993. 2 pages.
GenBank Submission; NIH/NCBI, Accession No. KR710351.1. Sahni et al., Jun. 1, 2015. 2 pages.
GenBank Submission; NIH/NCBI, Accession No. NC_002737.1. Ferretti et al., Jun. 27, 2013. 1 page.
GenBank Submission; NIH/NCBI, Accession No. NC_015683.1. Trost et al., Jul. 6, 2013. 1 page.
GenBank Submission; NIH/NCBI, Accession No. NC_016782.1. Trost et al., Jun. 11, 2013. 1 page.
GenBank Submission; NIH/NCBI, Accession No. NC_016786.1. Trost et al., Aug. 28, 2013. 1 page.
GenBank Submission; NIH/NCBI, Accession No. NC_017053.1. Fittipaldi et al., Jul. 6, 2013. 1 page.
GenBank Submission; NIH/NCBI, Accession No. NC_017317.1. Trost et al., Jun. 11, 2013. 1 page.
GenBank Submission; NIH/NCBI, Accession No. NC_017861.1. Heidelberg et al., Jun. 11, 2013. 1 page.
GenBank Submission; NIH/NCBI, Accession No. NC_018010.1. Lucas et al., Jun. 11, 2013. 2 pages.
GenBank Submission; NIH/NCBI, Accession No. NC_018721.1. Feng et al., Jun. 11, 2013. 1 pages.
GenBank Submission; NIH/NCBI, Accession No. NC_021284.1. Ku et al., Jul. 12, 2013. 1 page.
GenBank Submission; NIH/NCBI, Accession No. NC_021314.1. Zhang et al., Jul. 15, 2013. 1 page.
GenBank Submission; NIH/NCBI, Accession No. NC_021846.1. Lo et al., Jul. 22, 2013. 1 page.
GenBank Submission; NIH/NCBI, Accession No. NM_174936. Guo et al., Oct. 28, 2015. 6 pages.
GenBank Submission; NIH/NCBI, Accession No. NP_472073.1. Glaser et al., Jun. 27, 2013. 2 pages.

(56) References Cited

OTHER PUBLICATIONS

GenBank Submission; NIH/NCBI, Accession No. NP_955579.1. Chen et al., Aug. 13, 2018. 5 pages.
GenBank Submission; NIH/NCBI, Accession No. P42212. Prasher et al., Mar. 19, 2014. 7 pages.
GenBank Submission; NIH/NCBI, Accession No. RFF81513.1. Zhou et al., Aug. 21, 2018. 2 pages.
GenBank Submission; NIH/NCBI, Accession No. SNX31424.1. Weckx, S., Feb. 16, 2018. 2 pages.
GenBank Submission; NIH/NCBI, Accession No. TGH57013. Xu et al., Apr. 9, 2019. 2 pages.
GenBank Submission; NIH/NCBI, Accession No. WP_031386437. No Author Listed., Sep. 23, 2019. 1 page.
GenBank Submission; NIH/NCBI, Accession No. WP_0315 89969. 1. Haft et al., Oct. 9, 2019. 2 pages.
GenBank Submission; NIH/NCBI, Accession No. WP_044924278. 1. Haft et al., Oct. 9, 2019. 2 pages.
GenBank Submission; NIH/NCBI, Accession No. WP_047338501. 1. Haft et al., Oct. 9, 2019. 2 pages.
GenBank Submission; NIH/NCBI, Accession No. WP_060798984. 1. Haft et al., Oct. 9, 2019. 2 pages.
GenBank Submission; NIH/NCBI, Accession No. WP_062913273. 1. Haft et al., Oct. 9, 2019, 2 pages.
GenBank Submission; NIH/NCBI, Accession No. WP_072754838. No Author Listed., Sep. 23, 2019. 1 page.
GenBank Submission; NIH/NCBI, Accession No. WP_095142515. 1. No Author Listed., Sep. 23, 2019. 1 page.
GenBank Submission; NIH/NCBI, Accession No. WP_118538418. 1. No Author Listed., Oct. 13, 2019. 1 page.
GenBank Submission; NIH/NCBI, Accession No. WP_119223642. 1. No Author Listed., Oct. 13, 2019. 1 page.
GenBank Submission; NIH/NCBI, Accession No. WP_119227726. 1. No Author Listed., Oct. 13, 2019. 1 page.
GenBank Submission; NIH/NCBI, Accession No. WP_119623382. 1. No Author Listed., Oct. 13, 2019. 1 page.
GenBank Submission; NIH/NCBI, Accession No. WP_132221894. 1. No Author Listed., Sep. 23, 2019. 1 page.
GenBank Submission; NIH/NCBI, Accession No. WP_133478044. 1. Haft et al., Oct. 9, 2019. 2 pages.
GenBank Submission; NIH/NCBI, Accession No. YP_002342100. 1. Bernardini et al., Jun. 10, 2013. 2 pages.
GenBank Submission; NIH/NCBI, Accession No. YP_002344900. 1. Gundogdu et al., Mar. 19, 2014. 2 pages.
GenBank Submission; NIH/NCBI, Accession No. YP_009283008. 1. Bernardini et al., Sep. 23, 2016. 2 pages.
GenBank Submission; NIH/NCBI, Accession No. YP_820832.1. Makarova et al., Aug. 27, 2013. 2 pages.
George et al., Adenosine deaminases acting on RNA, RNA editing, and interferon action. J Interferon Cytokine Res. Jan. 2011;31(1):99-117. doi: 10.1089/jir.2010.0097. Epub Dec. 23, 2010. PMID: 21182352; PMCID: PMC3034097.
Gerard et al., Influence on stability in *Escherichia coli* of the carboxy-terminal structure of cloned Moloney murine leukemia virus reverse transcriptase. DNA. Aug. 1986;5(4):271-9. doi: 10.1089/dna.1986.5.271.
Gerard et al., Purification and characterization of the DNA polymerase and RNase H activities in Moloney murine sarcoma-leukemia virus. J Virol. Apr. 1975;15(4):785-97. doi: 10.1128/JVI.15.4.785-797.1975.
Gerard et al., The role of template-primer in protection of reverse transcriptase from thermal inactivation. Nucleic Acids Res. Jul. 15, 2002;30(14):3118-29. doi: 10.1093/nar/gkf417.
Gerber et al., An adenosine deaminase that generates inosine at the wobble position of tRNAs. Science. Nov. 5, 1999;286(5442):1146-9. doi: 10.1126/science.286.5442.1146.
Gerber et al., RNA editing by base deamination: more enzymes, more targets, new mysteries. Trends Biochem Sci. Jun. 2001;26(6):376-84.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/pkr421. Epub Jun. 7, 2011.
Ghahfarokhi et al., Blastocyst Formation Rate and Transgene Expression are Associated with Gene Insertion into Safe and Non-Safe Harbors in the Cattle Genome. Sci Rep. Nov. 13, 2017;7(1):15432. doi: 10.1038/s41598-017-15648-3.
Gibson et al., Enzymatic assembly of DNA molecules up to several hundred kilobases. Nat Methods. May 2009;6(5):343-5. doi: 10.1038/nmeth.1318. Epub Apr. 12, 2009.
Gil, Position-dependent sequence elements downstream of AAUAAA are required for efficient rabbit beta-globin mRNA 3' end formation. Cell. May 8, 1987;49(3):399-406. doi: 10.1016/0092-8674(87)90292-3.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Glasgow et al.,DNA-binding properties of the Hin recombinase. J Biol Chem. Jun. 15, 1989;264(17):10072-82.
Glassner et al., Generation of a strong mutator phenotype in yeast by imbalanced base excision repair. Proc Natl Acad Sci U S A. Aug. 18, 1998;95(17):9997-10002.
Goldberg et al., Epigenetics: a landscape takes shape. Cell. Feb. 23, 2007;128(4):635-8. doi: 10.1016/j.cell.2007.02.006.
Gong et al., Active DNA demethylation by oxidation and repair. Cell Res. Dec. 2011;21(12):1649-51. doi: 10.1038/cr.2011.140. Epub Aug. 23, 2011.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.
Goodnough et al., Development of a delivery vehicle for intracellular transport of botulinum neurotoxin antagonists. FEBS Lett. Feb. 27, 2002;513(2-3):163-8.
Gou et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.
Grainge et al., The integrase family of recombinase: organization and function of the active site. Mol Microbiol. Aug. 1999;33(3):449-56.
Gregory et al., Integration site for Streptomyces phage phiBT1 and development of site-specific integrating vectors. J Bacteriol. Sep. 2003;185(17):5320-3. doi: 10.1128/jb.185.17.5320-5323.2003.
Griffiths, Endogenous retroviruses in the human genome sequence. Genome Biol. 2001;2(6):REVIEWS1017. doi: 10.1186/GB-2001-2-6-reviews1017. Epub Jun. 5, 2001.
Grishok et al., Genes and Mechanisms Related to RNA Interference Regulate Expression of the Small Temporal RNAs that Control C. elegans Developmental Timing. Jul. 13, 2001:106(1):P23-4.
Groher et al., Synthetic riboswitches—A tool comes of age. Biochim Biophys Acta. Oct. 2014;1839(10):964-973. doi: 10.1016/j.bbagrm.2014.05.005. Epub May 17, 2014.
Groth et al., Construction of transgenic *Drosophila* by using the site-specific integrase from phage phiC31. Genetics. Apr. 2004;166(4):1775-82. doi: 10.1534/genetics.166.4.1775.
Gruber et al., Strategies for measuring evolutionary conservation of RNA secondary structures. BMC Bioinformatics. Feb. 26, 2008;9:122. doi: 10.1186/1471-2105-9-122.
Grunebaum et al., Recent advances in understanding and managing adenosine deaminase and purine nucleoside phosphorylase deficiencies. Curr Opin Allergy Clin Immunol. Dec. 2013;13(6):630-8. doi: 10.1097/ACI.0000000000000006.

(56) References Cited

OTHER PUBLICATIONS

Grünewald et al., Transcriptome-wide off-target RNA editing induced by CRISPR-guided DNA base editors. Nature. May 2019;569(7756):433-437. doi: 10.1038/s41586-019-1161-z. Epub Apr. 17, 2019.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.
Gumulya et al., Exploring the past and the future of protein evolution with ancestral sequence reconstruction: the 'retro' approach to protein engineering. Biochem J. Jan. 1, 2017;474(1):1-19. doi: 10.1042/BCJ20160507.
Guo et al., Facile functionalization of FK506 for biological studies by the thiol-ene 'click' reaction. RSC Advances. 2014;22:11400-3.
Guo et al., Protein tolerance to random amino acid change. Proc Natl Acad Sci U S A. Jun. 22, 2004;101(25):9205-10. Epub Jun. 14, 2004.
Gupta et al., Cross-talk between cognate and noncognate RpoE sigma factors and Zn(2+)-binding anti-sigma factors regulates photooxidative stress response in Azospirillum brasilense. Antioxid Redox Signal. Jan. 1, 2014;20(1):42-59. doi: 10.1089/ars.2013.5314. Epub Jul. 19, 2013.
Gupta et al., Sequences in attB that affect the ability of phiC31 integrase to synapse and to activate DNA cleavage. Nucleic Acids Res. 2007;35(10):3407-19. doi: 10.1093/nar/gkm206. Epub May 3, 2007.
Guzman et al., Tight regulation, modulation, and high-level expression by vectors containing the arabinose PBAD promoter. J Bacteriol. 1995;177(14):4121-4130.
Haapaniemi et al., CRISPR-Cas9 genome editing induces a p53-mediated DNA damage response. Nat Med. Jul. 2018;24(7):927-930. doi: 10.1038/s41591-018-0049-z. Epub Jun. 11, 2018.
Haddada et al., Gene therapy using adenovirus vectors. Curr Top Microbiol Immunol. 1995;199 ( Pt 3):297-306. doi: 10.1007/978-3-642-79586-2_14.
Haeussler et al., Evaluation of off-target and on-target scoring algorithms and integration into the guide RNA selection tool CRISPOR. Genome Biol. Jul. 5, 2016;17(1):148. doi: 10.1186/s13059-016-1012-2.
Hale et al., RNA-guided RNA cleavage by a CRISPR RNA-Cas protein complex. Cell. Nov. 25, 2009;139(5):945-56. doi: 10.1016/j.cell.2009.07.040.
Halmai et al., Targeted CRIPSR/dCas9-mediated reactivation of epigenetically silenced genes suggests limited escape from the inactive X chromosome. 2nd Intl Conf on Epigenetics and Bioengineering. Oct. 4, 2018; Retrieved from the Internet: https://aiche.confex.com/aiche/epibiol8/webprogram/paper544785.html. Retrieved Jun. 29, 2020.
Halperin et al., CRISPR-guided DNA polymerases enable diversification of all nucleotides in a tunable window. Nature. Aug. 2018;560(7717):248-252. doi: 10.1038/s41586-018-0384-8. Epub Aug. 1, 2018.
Halvas et al., Role of murine leukemia virus reverse transcriptase deoxyribonucleoside triphosphate-binding site in retroviral replication and in vivo fidelity. J Virol. Nov. 2000;74(22):10349-58. doi: 10.1128/jvi.74.22.10349-10358.2000.
Hamano-Takaku et al., A mutant *Escherichia coli* tyrosyl-tRNA synthetase utilizes the unnatural amino acid azatyrosine more efficiently than tyrosine. J Biol Chem. Dec. 22, 2000;275(51):40324-8.
Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna.
Handa et al., Template-assisted synthesis of adenine-mutagenized cDNA by a retroelement protein complex. Nucleic Acids Res. Oct. 12, 2018;46(18):9711-9725. doi: 10.1093/nar/gky620.
Hanson et al., Codon optimality, bias and usage in translation and mRNA decay. Nat Rev Mol Cell Biol. Jan. 2018;19(1):20-30. doi: 10.1038/nrm.2017.91. Epub Oct. 11, 2017.
Harms et al., Evolutionary biochemistry: revealing the historical and physical causes of protein properties. Nat Rev Genet. Aug. 2013;14(8):559-71. doi: 10.1038/nrg3540.
Harrington et al., A thermostable Cas9 with increased lifetime in human plasma. Nat Commun. Nov. 10, 2017;8(1):1424. doi: 10.1038/s41467-017-01408-4.
Harris et al., RNA Editing Enzyme APOBEC1 and Some of Its Homologs Can Act as DNA Mutators. Mol Cell. Nov. 2002;10(5):1247-53.
Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.
Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.
Hasegawa et al., Spontaneous mutagenesis associated with nucleotide excision repair in *Escherichia coli*. Genes Cells. May 2008;13(5):459-69. doi: 10.1111/j.1365-2443.2008.01185.x.
Hayes et al., Stop codons preceded by rare arginine codons are efficient determinants of SsrA tagging in *Escherichia coli*. Proc Natl Acad Sci U S A. Mar. 19, 2002;99(6):3440-5. Epub Mar. 12, 2002.
Hector et al., CDKL5 variants: Improving our understanding of a rare neurologic disorder. Neurol Genet. Dec. 15, 2017;3(6):e200. doi: 10.1212/NXG.0000000000000200.
Heidenreich et al., Non-homologous end joining as an important mutagenic process in cell cycle-arrested cells. Embo J. May 1, 2003;22(9):2274-83. doi: 10.1093/emboj/cdg203.
Held et al., In vivo correction of murine hereditary tyrosinemia type I by phiC31 integrase-mediated gene delivery. Mol Ther. Mar. 2005;11(3):399-408. doi: 10.1016/j.ymthe.2004.11.001.
Heller et al., Replisome assembly and the direct restart of stalled replication forks. Nat Rev Mol Cell Biol. Dec. 2006;7(12):932-43. Epub Nov. 8, 2006.
Hendricks et al., The S. cerevisiae Mag1 3-methyladenine DNA glycosylase modulates susceptibility to homologous recombination. DNA Repair (Amst). 2002;1(8):645-659.
Hermonat et al., Use of adeno-associated virus as a mammalian DNA cloning vector: transduction of neomycin resistance into mammalian tissue culture cells. Proc Natl Acad Sci U S A. Oct. 1984;81(20):6466-70. doi: 10.1073/pnas.81.20.6466.
Herschhorn et al., Retroviral reverse transcriptases. Cell Mol Life Sci. Aug. 2010;67(16):2717-47. doi: 10.1007/s00018-010-0346-2. Epub Apr. 1, 2010.
Herzig et al., A Novel Leu92 Mutant of HIV-1 Reverse Transcriptase with a Selective Deficiency in Strand Transfer Causes a Loss of Viral Replication. J Virol. Aug. 2015;89(16):8119-29. doi: 10.1128/JVI.00809-15. Epub May 20, 2015.
Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.
Hickford et al., Antitumour polyether macrolides: four new halichondrins from the New Zealand deep-water marine sponge *Lissodendoryx* sp. Bioorg Med Chem. Mar. 15, 2009;17(6):2199-203. doi: 10.1016/j.bmc.2008.10.093. Epub Nov. 19, 2008.
Hida et al., Directed evolution for drug and nucleic acid; delivery. Adv Drug Deliv Rev. Dec. 22, 2007;59(15):1562-78. Epub Aug. 28, 2007.; Review.
Higgs et al., Genetic complexity in sickle cell disease. Proc Natl Acad Sci USA. Aug. 19, 2008;105(33):11595-6. doi: 10.1073/pnas.0806633105. Epub Aug. 11, 2008.
Hill et al., Functional analysis of conserved histidines in ADP-glucose pyrophosphorylase from *Escherichia coli*.Biochem Biophys Res Commun. Mar. 17, 1998;244(2):573-7.
Hille et al., The Biology of CRISPR-Cas: Backward and Forward. Cell. Mar. 8, 2018;172(6):1239-1259. doi: 10.1016/j.cell.2017.11.032.

(56) References Cited

OTHER PUBLICATIONS

Hilton et al., Enabling functional genomics with genome engineering. Genome Res. Oct. 2015;25(10):1442-55. doi: 10.1101/gr.190124.115.
Hirano et al., Structural Basis for the Altered PAM Specificities of Engineered CRISPR-Cas9. Mol Cell. Mar. 17, 2016;61(6):886-94. doi: 10.1016/j.molcel.2016.02.018.
Hoang et al., UFBoot2: Improving the Ultrafast Bootstrap Approximation. Mol Biol Evol. Feb. 1, 2018;35(2):518-522. doi: 10.1093/molbev/msx281.
Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.
Hockemeyer et al., Genetic engineering of human pluripotent cells using TALE nucleases. Nat Biotechnol. Jul. 7, 2011;29(8):731-4. doi: 10.1038/nbt.1927.
Hoernes et al., Translating the epitranscriptome. Wiley Interdiscip Rev RNA. Jan. 2017;8(1):e1375. doi: 10.1002/wrna.1375. Epub Jun. 27, 2016.
Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.
Hollis et al., Phage integrases for the construction and manipulation of transgenic mammals. Reprod Biol Endocrinol. Nov. 7, 2003;1:79. doi: 10.1186/1477-7827-1-79.
Holsinger et al., Signal transduction in T lymphocytes using a conditional allele of Sos. Proc Natl Acad Sci U S A. Oct. 10, 1995;92(21):9810-4. doi: 10.1073/pnas.92.21.9810.
Hondares et al., Peroxisome Proliferator-activated Receptor ? (PPAR?) Induces PPAR? Coactivator 1? (PGC-1?) Gene Expression and Contributes to Thermogenic Activation of Brown Fat. J Biol. Chem Oct. 2011; 286(50):43112-22. doi: 10.1074/jbc.M111.252775.
Hoogenboom et al., Natural and designer binding sites made by phage display technology. Immunol Today. Aug. 2000;21(8):371-8.
Horvath et al., CRISPR/Cas, the immune system of bacteria and archaea. Science. Jan. 8, 2010;327(5962):167-70. doi: 10.1126/science.1179555.
Horvath et al., Diversity, Activity, and Evolution of CRISPR Loci in *Streptococcus thermophilus*. J Bacteriol. Feb. 2008;190(4):1401-12. doi: 10.1128/JB.01415-07. Epub Dec. 7, 2007.
Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.
Houdebine, The methods to generate transgenic animals and to control transgene expression. J Biotechnol. Sep. 25, 2002;98(2-3):145-60.
Howard et al., Intracerebral drug delivery in rats with lesion-induced memory deficits. J Neurosurg. Jul. 1989;71(1):105-12.
Hower et al., Shape-based peak identification for ChIP-Seq. BMC Bioinformatics. Jan. 12, 2011;12:15. doi: 10.1186/1471-2105-12-15.
Hsu et al., DNA targeting specificity of RNA-guided Cas9 nucleases. Nat Biotechnol. Sep. 2013;31(9):827-32. doi: 10.1038/nbt.2647. Epub Jul. 21, 2013.
Hsu et al., DNA targeting specificity of RNA-guided Cas9 nucleases. Nat Biotechnol. Sep. 2013;31(9):827-32. doi: 10.1038/nbt.2647. Epub Jul. 21, 2013. Supplementary Information. 27 pages.
Hu et al., Chemical Biology Approaches to Genome Editing: Understanding, Controlling, and Delivering Programmable Nucleases. Cell Chem Biol. Jan. 21, 2016;23(1):57-73. doi: 10.1016/j.chembiol.2015.12.009.
Hu et al., Evolved Cas9 variants with broad PAM compatibility and high DNA specificity. Nature. Apr. 5, 2018;556(7699):57-63. doi: 10.1038/nature26155. Epub Feb. 28, 2018.
Huang et al., Circularly permuted and PAM-modified Cas9 variants broaden the targeting scope of base editors. Nat Biotechnol. Jun. 2019;37(6):626-631. doi: 10.1038/s41587-019-0134-y. Epub May 20, 2019. Including Supplementary Information.
Huang et al., Heritable gene targeting in zebrafish using customized TALENs. Nat Biotechnol. Aug. 5, 2011;29(8):699-700. doi: 10.1038/nbt.1939.
Huggins et al., Flap endonuclease 1 efficiently cleaves base excision repair and DNA replication intermediates assembled into nucleosomes. Mol Cell. Nov. 2002;10(5):1201-11. doi: 10.1016/81097-2765(02)00736-0.
Humbert et al., Targeted gene therapies: tools, applications, optimization. Crit Rev Biochem Mol Biol. May-Jun. 2012;47(3):264-81. doi: 10.3109/10409238.2012.658112.
Hung et al., Protein localization in disease and therapy. J Cell Sci. Oct. 15, 2011;124(Pt 20):3381-92. doi: 10.1242/jcs.089110.
Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.
Husimi, Selection and evolution of bacteriophages in cellstat. Adv Biophys. ; 1989;25:1-43. Review.
Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.
Hwang et al., Efficient In Vivo Genome Editing Using RNA-Guided Nucleases. Nat Biotechnol. Mar. 2013; 31(3): 227-229. doi: 10.1038/nbt.2501. Epub Jan. 29, 2013.
Hwang et al., Web-based design and analysis tools for CRISPR base editing. BMC Bioinformatics. Dec. 27, 2018;19(1):542. doi: 10.1186/s12859-018-2585-4.
Ibba et al., Relaxing the substrate specificity of an aminoacyl-tRNA synthetase allows in vitro and in vivo synthesis of proteins containing unnatural amino acids. FEBS Lett. May 15, 1995;364(3):272-5.
Ibba et al., Substrate specificity is determined by amino acid binding pocket size in *Escherichia coli* phenylalanyl-tRNA synthetase. Biochemistry. Jun. 14, 1994;33(23):7107-12.
Ihry et al., p53 inhibits CRISPR-Cas9 engineering in human pluripotent stem cells. Nat Med. Jul. 2018;24(7):939-946. doi: 10.1038/s41591-018-0050-6. Epub Jun. 11, 2018.
Iida et al., A site-specific, conservative recombination system carried by bacteriophage P1. Mapping the recombinase gene cin and the cross-over sites cix for the inversion of the C segment. EMBO J. 1982;1(11):1445-53.
Iida et al., The Min DNA inversion enzyme of plasmid p15B of *Escherichia coli* 15T—: a new member of the Din family of site-specific recombinases. Mol Microbiol. Jun. 1990;4(6):991-7. doi: 10.1111/j.1365-2958.1990.tb00671.x.
Ikediobi et al., Mutation analysis of 24 known cancer genes in the NCI-60 cell line set. Mol Cancer Ther. Nov. 2006;5(11):2606-12. Epub Nov. 6, 2006.
Imanishi et al., Detection of N6-methyladenosine based on the methyl-sensitivity of MazF RNA endonuclease. Chem Commun (Camb). Nov. 30, 2017;53(96):12930-12933. doi: 10.1039/c7cc07699a.
Imburgio et al., Studies of promoter recognition and start site selection by T7 RNA polymerase using a comprehensive collection of promoter variants. Biochemistry. Aug. 29, 2000;39(34):10419-30.
Ingram, A specific chemical difference between the globins of normal human and sickle-cell anaemia haemoglobin. Nature. Oct. 13, 1956;178(4537):792-4. doi: 10.1038/178792a0.
International Preliminary Report on Patentability for PCT/US2018/021878, dated Sep. 19, 2019.
International Search Report and Written Opinion for PCT/US2018/021878, dated Aug. 20, 2018.
Invitation to Pay Additional Fees and, Where Applicable, Protest Fee for PCT/US2018/021878, dated Jun. 8, 2008.
Irion et al., Identification and targeting of the ROSA26 locus in human embryonic stem cells. Nat Biotechnol. Dec. 2007;25(12):1477-82. doi: 10.1038/nbt1362. Epub Nov. 25, 2007.
Irrthum et al., Congenital hereditary lymphedema caused by a mutation that inactivates VEGFR3 tyrosine kinase. Am J Hum Genet. Aug. 2000;67(2):295-301. Epub Jun. 9, 2000.

(56) References Cited

OTHER PUBLICATIONS

Ishino et al., Nucleotide sequence of the iap gene, responsible for alkaline phosphatase isozyme conversion in *Escherichia coli*, and identification of the gene product. J Bacteriol. Dec. 1987;169(12):5429-33.
Iwai et al., Circular beta-lactamase: stability enhancement by cyclizing the backbone. FEBS Lett. Oct. 8, 1999;459(2):166-72. doi: 10.1016/s0014-5793(99)01220-x.
Iwai et al., Highly efficient protein trans-splicing by a naturally split DnaE intein from Nostoc punctiforme. FEBS Lett. Mar. 20, 2006;580(7):1853-8. doi: 10.1016/j.febslet.2006.02.045. Epub Feb. 24, 2006.
Jaffrey et al., Emerging links between m6A and misregulated mRNA methylation in cancer. Genome Med. Jan. 12, 2017;9(1):2. doi: 10.1186/s13073-016-0395-8.
Jamieson et al., Drug discovery with engineered zinc-finger proteins. Nat Rev Drug Discov. May 2003;2(5):361-8.
Jansen et al., Backbone and nucleobase contacts to glucosamine-6-phosphate in the glmS ribozyme. Nat Struct Mol Biol. Jun. 2006;13(6):517-23. Epub May 14, 2006.
Jansen et al., Identification of genes that are associated with DNA repeats in prokaryotes. Mol Microbiol. Mar. 2002;43(6):1565-75.
Jardine et al., HIV-1 Vaccines. Priming a broadly neutralizing antibody response to HIV-1 using a germline-targeting immunogen. Science. Jul. 10, 2015;349(6244):156-61. doi: 10.1126/science.aac5894. Epub Jun. 18, 2015.
Jasin et al., Repair of strand breaks by homologous recombination. Cold Spring Harb Perspect Biol. Nov. 1, 2013;5(11):a012740. doi: 10.1101/cshperspect.a012740.
Jeggo, DNA breakage and repair. Adv Genet. 1998;38:185-218. doi: 10.1016/s0065-2660(08)60144-3.
Jemiflity et al., Novel “anti-reverse” cap analogs with superior translational properties. RNA. Sep. 2003;9(9):1108-22. doi: 10.1261/rna.5430403.
Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.
Jeong et al., Measurement of deoxyinosine adduct: Can it be a reliable tool to assess oxidative or nitrosative DNA damage? Toxicol Lett. Oct. 17, 2012;214(2):226-33. doi: 10.1016/j.toxlet.2012.08.013. Epub Aug. 23, 2012.
Jiang et al., CRISPR-Cas9 Structures and Mechanisms. Annu Rev Biophys. May 22, 2017;46:505-529. doi: 10.1146/annurev-biophys-062215-010822. Epub Mar. 30, 2017.
Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.
Jiang et al., Structural Biology. A Cas9-guide RNA Complex Preorganized for Target DNA Recognition. Science. Jun. 26, 2015;348(6242):1477-81. doi: 10.1126/science.aab1452.
Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.
Jin et al., Cytosine, but not adenine, base editors induce genome-wide off-target mutations in rice. Science. Apr. 19, 2019;364(6437):292-295. doi: 10.1126/science.aaw7166. Epub Feb. 28, 2019.
Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.
Jinek et al., RNA-programmed genome editing in human cells. Elife. Jan. 29, 2013;2:e00471. doi: 10.7554/eLife.00471.
Jinek et al., Structures of Cas9 endonucleases reveal RNA-mediated conformational activation. Science. Mar. 14, 2014;343(6176):1247997. doi: 10.1126/science.1247997. Epub Feb. 6, 2014.
Jiricny, The multifaceted mismatch-repair system. Nat Rev Mol Cell Biol. May 2006;7(5):335-46. doi: 10.1038/nrm1907.
Johann et al., GLVR1, a receptor for gibbon ape leukemia virus, is homologous to a phosphate permease of Neurospora crassa and is expressed at high levels in the brain and thymus. J Virol. Mar. 1992;66(3):1635-40. doi: 10.1128/JVI.66.3.1635-1640.1992.
Johansson et al., RNA Recognition by the MS2 Phage Coat Protein. Seminars in Virology. 1997;8(3):176-85. https://doi.org/10.1006/smvy.1997.0120.
Johansson et al., Selenocysteine in proteins—properties and biotechnological use. Biochim Biophys Acta. Oct. 30, 2005;1726(1):1-13. Epub Jun. 1, 2005.
Johns et al., The promise and peril of continuous in vitro evolution. J Mol Evol. Aug. 2005;61(2):253-63. Epub Jun. 27, 2005.
Joho et al., Identification of a region of the bacteriophage T3 and T7 RNA polymerases that determines promoter specificity. J Mol Biol. Sep. 5, 1990;215(1):31-9.
Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.
JOUNG et al.,TALENs: a widely applicable technology for targeted genome editing. Nat Rev Mol Cell Biol. Jan. 2013;14(1):49-55. doi: 10.1038/nrm3486. Epub Nov. 21, 2012.
Joyce et al., Amplification, mutation and selection of catalytic RNA. Gene. Oct. 15, 1989;82(1):83-7. doi: 10.1016/0378-1119(89)90033-4.
Jusiak et al., Comparison of Integrases Identifies Bxb1-GA Mutant as the Most Efficient Site-Specific Integrase System in Mammalian Cells. ACS Synth Biol. Jan. 18, 2019;8(1):16-24. doi: 10.1021/acssynbio.8b00089. Epub Jan. 9, 2019.
Jyothy et al., Translocation Down syndrome. Indian J Med Sci. Mar. 2002;56(3):122-6.
Kacian et al., Purification of the DNA polymerase of avian myeloblastosis virus. Biochim Biophys Acta. Sep. 24, 1971;246(3):365-83. doi: 10.1016/0005-2787(71)90773-8.
Kaczmarczyk et al., Manipulating the Prion Protein Gene Sequence and Expression Levels with CRISPR/Cas9. PLoS One. Apr. 29, 2016;11(4):e0154604. doi: 10.1371/journal.pone.0154604.
Kadoch et al., Reversible disruption of mSWI/SNF (BAF) complexes by the SS18-SSX oncogenic fusion in synovial sarcoma. Cell. Mar. 28, 2013;153(1):71-85. doi: 10.1016/j.cell.2013.02.036.
Kahmann et al., G inversion in bacteriophage Mu DNA is stimulated by a site within the invertase gene and a host factor. Cell. Jul. 1985;41(3):771-80. doi: 10.1016/s0092-8674(85)80058-1.
Kaiser et al., Gene therapy. Putting the fingers on gene repair. Science. Dec. 23, 2005;310(5756):1894-6.
Kakiyama et al., A peptide release system using a photo-cleavable linker in a cell array format for cell-toxicity analysis. Polymer J. Feb. 27, 2013;45:535-9.
Kalyaanamoorthy et al., ModelFinder: fast model selection for accurate phylogenetic estimates. Nat Methods. Jun. 2017;14(6):587-589. doi: 10.1038/nmeth.4285. Epub May 8, 2017.
Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.
Kang et al., Structural Insights into riboswitch control of the biosynthesis of queuosine, a modified nucleotide found in the anticodon of tRNA. Mol Cell. Mar. 27, 2009;33(6):784-90. doi: 10.1016/j.molcel.2009.02.019. Epub Mar. 12, 2009.
Kao et al., Cleavage specificity of *Saccharomyces cerevisiae* flap endonuclease 1 suggests a double-flap structure as the cellular substrate. J Biol Chem. Apr. 26, 2002;277(17):14379-89. doi: 10.1074/jbc.M110662200. Epub Feb. 1, 2002.
Kappel et al., Regulating gene expression in transgenic animals. Curr Opin Biotechnol. Oct. 1992;3(5):548-53.
Karimova et al., Discovery of Nigri/nox and Panto/pox site-specific recombinase systems facilitates advanced genome engineering. Sci Rep. Jul. 22, 2016;6:30130. doi: 10.1038/srep30130.
Karimova et al., Vika/vox, a novel efficient and specific Cre/loxP-like site-specific recombination system. Nucleic Acids Res. Jan. 2013;41(2):e37. doi: 10.1093/nar/gks1037. Epub Nov. 9, 2012.
Karpenshih et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.

(56) References Cited

OTHER PUBLICATIONS

Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.
Katafuchi et al., DNA polymerases involved in the incorporation of oxidized nucleotides into DNA: their efficiency and template base preference. Mutat Res. Nov. 28, 2010;703(1):24-31. doi: 10.1016/j.mrgentox.2010.06.004. Epub Jun. 11, 2010.
Kato et al., Improved purification and enzymatic properties of three forms of reverse transcriptase from avian myeloblastosis virus. J Virol Methods. Dec. 1984;9(4):325-39. doi: 10.1016/0166-0934(84)90058-2.
Katoh et al., MAFFT multiple sequence alignment software version 7: improvements in performance and usability. Mol Biol Evol. Apr. 2013;30(4):772-80. doi: 10.1093/molbev/mst010. Epub Jan. 16, 2013.
Kaufman et al., Translational efficiency of polycistronic mRNAs and their utilization to express heterologous genes in mammalian cells. EMBO J. Jan. 1987;6(1):187-93.
Kavli et al., Excision of cytosine and thymine from DNA by mutants of human uracil-DNA glycosylase. EMBO J. Jul. 1, 1996;15(13):3442-7.
Kawaras Aki et al., Enhanced crossover SCRATCHY: construction and high-throughput screening of a combinatorial library containing multiple non-homologous crossovers. Nucleic Acids Res. Nov. 1, 2003;31(21):e126.
Kaya et al., A bacterial Argonaute with noncanonical guide RNA specificity. Proc. Natl. Acad. Sci. USA Apr. 2016;113(15):4057-62.
Keijzers et al., Human exonuclease 1 (EXO1) activity characterization and its function on flap structures. Biosci Rep. Apr. 25, 2015;35(3):e00206. doi: 10.1042/BSR20150058.
Kellendonk et al., Regulation of Cre recombinase activity by the synthetic steroid RU 486. Nucleic Acids Res. Apr. 15, 1996;24(8):1404-11.
Kelman, PCNA: structure, functions and interactions. Oncogene. Feb. 13, 1997;14(6):629-40. doi: 10.1038/sj.onc.1200886.
Keravala et al., A diversity of serine phage integrases mediate site-specific recombination in mammalian cells. Mol Genet Genomics. Aug. 2006;276(2):135-46. doi: 10.1007/s00438-006-0129-5. Epub May 13, 2006.
Kessel et al., Murine developmental control genes. Science. Jul. 27, 1990;249(4967):374-9. doi: 10.1126/science.1974085.
Kessler et al., Gene delivery to skeletal muscle results in sustained expression and systemic delivery of a therapeutic protein. Proc Natl Acad Sci U S A. Nov. 26, 1996;93(24):14082-7. doi: 10.1073/pnas.93.24.14082.
Ketha et al., Application of bioinformatics-coupled experimental analysis reveals a new transport-competent nuclear localization signal in the nucleoprotein of Influenza A virus strain. BMC Cell Biol. Apr. 28, 2008; 9:22. https://doi.org/10.1186/1471-2121-9-22.
Kiga et al., An engineered *Escherichia coli* tyrosyl-tRNA synthetase for site-specific incorporation of an unnatural amino acid into proteins in eukaryotic translation and its application in a wheat germ cell-free system. Proc Natl Acad Sci U S A. Jul. 23, 2002;99(15):9715-20. Epub Jul. 3, 2002.
Kilcher et al., Brochothrix thermosphacta bacteriophages feature heterogeneous and highly mosaic genomes and utilize unique prophage insertion sites. J Bacteriol. Oct. 2010;192(20):5441-53. doi: 10.1128/JB.00709-10. Epub Aug. 13, 2010.
Kim et al., DJ-1, a novel regulator of the tumor suppressor PTEN. Cancer Cell. 2005;7(3):263-273.
Kim et al., Genome-wide target specificity of CRISPR RNA-guided adenine base editors. Nat Biotechnol. Apr. 2019;37(4):430-435. doi: 10.1038/s41587-019-0050-1. Epub Mar. 4, 2019.
Kim et al., A library of TAL effector nucleases spanning the human genome. Nat Biotechnol. Mar. 2013;31(3):251-8. Doi: 10.1038/nbt.2517. Epub Feb. 17, 2013.
Kim et al., An anionic human protein mediates cationic liposome delivery of genome editing proteins into mammalian cells. Nat Commun. Jul. 2, 2019;10(1):2905. doi: 10.1038/s41467-019-10828-3.
Kim et al., Evaluating and Enhancing Target Specificity of Gene-Editing Nucleases and Deaminases. Annu Rev Biochem. Jun. 20, 2019;88:191-220. doi: 10.1146/annurev-biochem-013118-111730. Epub Mar. 18, 2019.
Kim et al., Genome-wide target specificities of CRISPR RNA-guided programmable deaminases. Nat Biotechnol. May 2017;35(5):475-480. doi: 10.1038/nbt.3852. Epub Apr. 10, 2017.
Kim et al., High cleavage efficiency of a 2A peptide derived from porcine teschovirus-1 in human cell lines, zebrafish and mice. PLoS One. 2011;6(4):e18556. doi: 10.1371/journal.pone.0018556. Epub Apr. 29, 2011.
Kim et al., Highly efficient RNA-guided base editing in mouse embryos. Nat Biotechnol. May 2017;35(5):435-437. doi: 10.1038/nbt.3816. Epub Feb. 27, 2017.
Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.
Kim et al., High-throughput analysis of the activities of xCas9, SpCas9-NG and SpCas9 at matched and mismatched target sequences in human cells. Nat Biomed Eng. Jan. 2020;4(1):111-124. doi: 10.1038/s41551-019-0505-1. Epub Jan. 14, 2020.
Kim et al., In vivo high-throughput profiling of CRISPR-Cpf1 activity. Nat Methods. Feb. 2017;14(2):153-159. doi: 10.1038/nmeth.4104. Epub Dec. 19, 2016.
Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.
Kim et al., Mycobacteriophage Bxb1 integrates into the *Mycobacterium smegmatis* groEL1 gene. Mol Microbiol. Oct. 2003;50(2):463-73. doi: 10.1046/j.1365-2958.2003.03723.x.
KIM et al., Rescue of high-specificity Cas9 variants using sgRNAs with matched 5' nucleotides. Genome Biol. Nov. 15, 2017;18(1):218. doi: 10.1186/s13059-017-1355-3.
Kim et al., Structural and kinetic characterization of *Escherichia coli* TadA, the wobble-specific tRNA deaminase. Biochemistry. May 23, 2006;45(20):6407-16. doi: 10.1021/bi0522394. PMID: 16700551.
Kim et al., TALENs and ZFNs are associated with different mutationsignatures. Nat Methods. Mar. 2013;10(3):185. doi: 10.1038/nmeth.2364. Epub Feb. 10, 2013.
Kim et al., Targeted genome editing in human cells with zinc finger nucleases constructed via modular assembly. Genome Res. Jul. 2009;19(7):1279-88. doi: 10.1101/gr.089417.108. Epub May 21, 2009.
Kim et al., The role of apolipoprotein E in Alzheimer's disease. Neuron. Aug. 13, 2009;63(3):287-303. doi: 10.1016/j.neuron.2009.06.026.
Kim et al., Transcriptional repression by zinc finger peptides. Exploring the potential for applications in gene therapy. J Biol Chem. Nov. 21, 1997;272(47):29795-800.
Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.
Klapacz et al., Frameshift mutagenesis and micro satellite instability induced by human alkyladenine DNA glycosylase. Mol Cell. Mar. 26, 2010;37(6):843-53. doi: 10.1016/j.molcel.2010.01.038.
Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.
Klein et al., Cocrystal structure of a class I preQ1 riboswitch reveals a pseudoknot recognizing an essential hypermodified nucleobase. Nat Struct Mol Biol. Mar. 2009;16(3):343-4. doi: 10.1038/nsmb.1563.Epub Feb. 22, 2009.

(56) References Cited

OTHER PUBLICATIONS

Kleiner et al., In vitro selection of a DNA-templated small-molecule library reveals a class of macrocyclic kinase inhibitors. J Am Chem Soc. Aug. 25, 2010;132(33):11779-91. doi: 10.1021/ja104903x.
Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.
Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.
Kleinstiver et al., High-fidelity CRISPR-Cas9 nucleases with no detectable genome-wide off-target effects. Nature. Jan. 28, 2016;529(7587):490-5. doi: 10.1038/nature16526. Epub Jan. 6, 2016.
Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.
Klement et al., Discrimination between bacteriophage T3 and T7 promoters by the T3 and T7 RNA polymerases depends primarily upon a three base-pair region located 10 to 12 base-pairs upstream from the start site. J Mol Biol. Sep. 5, 1990;215(1):21-9.
Klippel et al., Isolation and characterization of unusual gin mutants. EMBO J. Dec. 1, 1988;7(12):3983-9.
Klippel et al., The DNA invertase Gin of phage Mu: formation of a covalent complex with DNA via a phosphoserine at amino acid position 9. EMBO J. Apr. 1988;7(4):1229-37.
Klompe et al., Transposon-encoded CRISPR-Cas systems direct RNA-guided DNA integration. Nature. Jul. 2019;571(7764):219-225. doi: 10.1038/s41586-019-1323-z. Epub Jun. 12, 2019.
Knott et al., Guide-bound structures of an RNA-targeting A-cleaving CRISPR-Cas13a enzyme. Nat Struct Mol Biol. Oct. 2017;24(10):825-833. doi: 10.1038/nsmb.3466. Epub Sep. 11, 2017.
Koblan et al., Improving cytidine and adenine base editors by expression optimization and ancestral reconstruction. Nat Biotechnol. Oct. 2018;36(9):843-846. doi: 10.1038/nbt.4172. Epub May 29, 2018.
Kobori et al., Deep Sequencing Analysis of Aptazyme Variants Based on a Pistol Ribozyme. ACS Synth Biol. Jul. 21, 2017;6(7):1283-1288. doi: 10.1021/acssynbio.7b00057. Epub Apr. 14, 2017.
Kohli et al., A portable hot spot recognition loop transfers sequence preferences from APOBEC family members to activation-induced cytidine deaminase. J Biol Chem. Aug. 21, 2009;284(34):22898-904. doi: 10.1074/jbc.M109.025536. Epub Jun. 26, 2009.
Kohli et al., Local sequence targeting in the AID/APOBEC family differentially impacts retroviral restriction and antibody diversification. J Biol Chem. Dec. 24, 2010;285(52):40956-64. doi: 10.1074/jbc.M110.177402. Epub Oct. 6, 2010.
Köhrer et al., A possible approach to site-specific insertion of two different unnatural amino acids into proteins in mammalian cells via nonsense suppression. Chem Biol. Nov. 2003;10(11):1095-102.
Köhrer et al., Complete set of orthogonal 21st aminoacyl-tRNA synthetase-amber, ochre and opal suppressor tRNA pairs: concomitant suppression of three different termination codons in an mRNA in mammalian cells. Nucleic Acids Res. Dec. 1, 2004;32(21):6200-11. Print 2004.
Koike-Yusa et al., Genome-wide recessive genetic screening in mammalian cells with a lentiviral CRISPR-guide RNA library. Nat Biotechnol. Mar. 2014;32(3):267-73. doi: 10.1038/nbt.2800. Epub Dec. 23, 2013.
Kolot et al., Site promiscuity of coliphage HK022 integrase as a tool for gene therapy. Gene Ther. Jul. 2015;22(7):521-7. doi: 10.1038/gt.2015.9. Epub Mar. 12, 2015.
Kolot et al., Site-specific recombination in mammalian cells expressing the Int recombinase of bacteriophage HK022. Mol Biol Rep. Aug. 1999;26(3):207-13. doi: 10.1023/a:1007096701720.
Komor et al., CRISPR-Based Technologies for the Manipulation of Eukaryotic Genomes. Cell. Jan. 12, 2017;168(1-2):20-36. doi: 10.1016/j.cell.2016.10.044.
Komor et al., Improved base excision repair inhibition and bacteriophage Mu Gam protein yields C:G-to-T:A base editors with higher efficiency and product purity. Sci Adv. Aug. 30, 2017;3(8):eaao4774. doi: 10.1126/sciadv.aao4774. eCollection Aug. 2017.
Komor et al., Programmable editing of a target base in genomic DNA without double-stranded DNA cleavage. Nature. Apr. 20, 2016;533(7603):420-4. doi: 10.1038/nature17946.
Komor, Editing the Genome Without Double-Stranded DNA Breaks. ACS Chem Biol. Feb. 16, 2018;13(2):383-388. doi: 10.1021/acschembio.7b00710. Epub Oct. 9, 2017.
Konermann et al., Genome-scale transcriptional activation by an engineered CRISPR-Cas9 complex. Nature. Jan. 29, 2015;517(7536):583-8. doi: 10.1038/nature14136. Epub Dec. 10, 2014.
Koonin et al., Diversity, classification and evolution of CRISPR-Cas systems. Curr Opin Microbiol. 2017;37:67?78. doi:10.1016/j.mib.2017.05.008.
Kosicki et al., Repair of double-strand breaks induced by CRISPR-Cas9 leads to large deletions and complex rearrangements. Nat Biotechnol. Sep. 2018;36(8):765-771. doi: 10.1038/nbt.4192. Epub Jul. 16, 2018.
Kotewicz et al., Cloning and overexpression of Moloney murine leukemia virus reverse transcriptase in *Escherichia coli*. Gene. 1985;35(3):249-58. doi: 10.1016/0378-1119(85)90003-4.
Kotewicz et al., Isolation of cloned Moloney murine leukemia virus reverse transcriptase lacking ribonuclease H activity. Nucleic Acids Res. Jan. 11, 1988;16(1):265-77. doi: 10.1093/nar/16.1.265.
Kotin, Prospects for the use of adeno-associated virus as a vector for human gene therapy. Hum Gene Ther. Jul. 1994;5(7):793-801. doi: 10.1089/hum.1994.5.7-793.
Kouzminova et al., Patterns of chromosomal fragmentation due to uracil-DNA incorporation reveal a novel mechanism of replication-dependent double-stranded breaks. Mol Microbiol. Apr. 2008;68(1):202-15. doi: 10.1111/j.1365-2958.2008.06149.x.
Kowal et al., Exploiting unassigned codons in Micrococcus luteus for tRNA-based amino acid mutagenesis. Nucleic Acids Res. Nov. 15, 1997;25(22):4685-9.
Kowalski et al., Delivering the Messenger: Advances in Technologies for Therapeutic mRNA Delivery. Mol Ther. Apr. 10, 2019;27(4):710-728. doi: 10.1016/j.ymthe.2019.02.012. Epub Feb. 19, 2019.
Kozak, An analysis of 5'-noncoding sequences from 699 vertebrate messenger RNAs. Nucleic Acids Res. Oct. 26, 1987;15(20):8125-48. doi: 10.1093/nar/15.20.8125.
Kraft et al., Deletions, Inversions, Duplications: Engineering of Structural Variants using CRISPR/Cas in Mice. Cell Rep. Feb. 10, 2015;10(5):833-839. doi: 10.1016/j.celrep.2015.01.016. Epub Feb. 7, 2015.
Kremer et al., Adenovirus and adeno-associated virus mediated gene transfer. Br Med Bull. Jan. 1995;51(1):31-44. doi: 10.1093/oxfordjournals.bmb.a072951.
Krokan et al., Uracil in DNA—occurrence, consequences and repair. Oncogene. Dec. 16, 2002;21(58):8935-48. doi: 10.1038/sj.onc.1205996.
Krokan et al., Base excision repair. Cold Spring Harb Perspect Biol. Apr. 1, 2013;5(4):a012583. doi: 10.1101/cshperspect.a012583.
Krzywkowski et al., Limited reverse transcriptase activity of phi29 DNA polymerase. Nucleic Acids Res. Apr. 20, 2018;46(7):3625-3632. doi: 10.1093/nar/gky190.
Kugler et al., Human synapsin 1 gene promoter confers highly neuron-specific long-term transgene expression from an adenoviral vector in the adult rat brain depending on the transduced area. Gene Ther. Feb. 2003;10(4):337-47. doi: 10.1038/sj.gt.3301905.
Kumar et al., Structural and functional consequences of the mutation of a conserved arginine residue in alphaA and alphaB crystallins. J Biol Chem. Aug. 20, 1999;274(34):24137-41.
Kundu et al., Leucine to proline substitution by SNP at position 197 in Caspase-9 gene expression leads to neuroblastoma: a bioinformatics analysis. 3 Biotech. 2013; 3:225-34.
Kunkel et al., Eukaryotic Mismatch Repair in Relation to DNA Replication. Annu Rev Genet. 2015;49:291-313. doi: 10.1146/annurev-genet-112414-054722.

(56) References Cited

OTHER PUBLICATIONS

Kunz et al., DNA Repair in mammalian cells: Mismatched repair: variations on a theme. Cell Mol Life Sci. Mar. 2009;66(6):1021-38. doi: 10.1007/s00018-009-8739-9.

Kurjan et al., Structure of a yeast pheromone gene (MF alpha): a putative alpha-factor precursor contains four tandem copies of mature alpha-factor. Cell. Oct. 1982;30(3):933-43. doi: 10.1016/0092-8674(82)90298-7.

Kury et al., De Novo Disruption of the Proteasome Regulatory Subunit PSMD12 Causes a Syndromic Neurodevelopmental Disorder. Am J Hum Genet. Feb. 2, 2017;100(2):352-363. doi: 10.1016/j.ajhg.2017.01.003. Epub Jan. 26, 2017.

Kuscu et al., CRISPR-Cas9-AID base editor is a powerful gain-of-function screening tool. Nat Methods. Nov. 29, 2016;13(12):983-984. doi: 10.1038/nmeth.4076.

Kuscu et al., CRISPR-STOP: gene silencing through base-editing-induced nonsense mutations. Nat Methods. Jul. 2017;14(7):710-712. doi: 10.1038/nmeth.4327. Epub Jun. 5, 2017.

Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.

Kwart et al., Precise and efficient scarless genome editing in stem cells using CORRECT. Nat Protoc. Feb. 2017;12(2):329-354. doi: 10.1038/nprot.2016.171. Epub Jan. 19, 2017.

Kweon et al., Fusion guide RNAs for orthogonal gene manipulation with Cas9 and Cpf1. Nat Commun. Nov. 23, 2017;8(1):1723. doi: 10.1038/s41467-017-01650-w. Erratum in: Nat Commun. Jan. 16, 2018;9(1):303.

Kwon et al., Chemical basis of glycine riboswitch cooperativity. RNA. Jan. 2008;14(1):25-34. Epub Nov. 27, 2007.

Lada et al., Mutator effects and mutation signatures of editing deaminases produced in bacteria and yeast. Biochemistry (Mosc). Jan. 2011;76(1):131-46.

Lakich et al., Inversions disrupting the factor VIII gene are a common cause of severe haemophilia A. Nat Genet. Nov. 1993;5(3):236-41. doi: 10.1038/ng1193-236.

Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.

Landrum et al., ClinVar: public archive of relationships among sequence variation and human phenotype. Nucleic Acids Res. Jan. 2014;42(Database issue):D980-5. doi: 10.1093/nar/gkt1113. Epub Nov. 14, 2013.

Langer et al., Chemical and Physical Structure of Polymers as Carriers for Controlled Release of Bioactive Agents: A Review. Journal of Macromolecular Science, 2006;23(1):61-126. DOI: 10.1080/07366578308079439.

Langer et al., New methods of drug delivery. Science. Sep. 28, 1990;249(4976):1527-33.

Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.

Lau et al., Molecular basis for discriminating between normal and damaged bases by the human alkyladenine glycosylase, AAG. Proc Natl Acad Sci U S A. Dec. 5, 2000;97(25):13573-8.

Lauer et al., Construction, characterization, and use of two Listeria monocytogenes sitespecific phage integration vectors. J Bacteriol. Aug. 2002;184(15):4177-86. doi: 10.1128/jb.184.15.4177-4186.2002.

Lavergne et al., Defects in type IIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.

Lawrence et al., Supercharging proteins can impart unusual resilience. J Am Chem Soc. Aug. 22, 2007;129(33):10110-2. Epub Aug. 1, 2007.

Lawyer et al., High-level expression, purification, and enzymatic characterization of full-length Thermus aquaticus DNA polymerase and a truncated form deficient in 5' to 3' exonuclease activity. PCR Methods Appl. May 1993;2(4):275-87. doi: 10.1101/gr.2.4.275.

Lazar et al., Transforming growth factor alpha: mutation of aspartic acid 47 and leucine 48 results in different biological activities. Mol Cell Biol. Mar. 1988;8(3):1247-52.

Lazarevic et al., Nucleotide sequence of the Bacillus subtilis temperate bacteriophage SPbetac2. Microbiology (Reading). May 1999;145 ( Pt 5):1055-1067. doi: 10.1099/13500872-145-5-1055.

Le Grice et al., Purification and characterization of recombinant equine infectious anemia virus reverse transcriptase. J Virol. Dec. 1991;65(12):7004-7. doi: 10.1128/JVI.65.12.7004-7007.1991.

Leaver-Fay et al., ROSETTA3: an object-oriented software suite for the simulation and design of macromolecules. Methods Enzymol. 2011;487:545-74. doi: 10.1016/B978-0-12-381270-4.00019-6.

Leconte et al., A population-based experimental model for protein evolution: effects of mutation rate and selection stringency on evolutionary outcomes. Biochemistry. Feb. 26, 2013;52(8):1490-9. doi: 10.1021/bi3016185. Epub Feb. 14, 2013.

Ledford, Gene-editing hack yields pinpoint precision. Nature, Apr. 20, 2016. http://www.nature.com/news/gene-editing-hack-yields-pinpoint-precision-1.19773.

Lee et al., A chimeric thyroid hormone receptor constitutively bound to DNA requires retinoid X receptor for hormone-dependent transcriptional activation in yeast. Mol Endocrinol. Sep. 1994;8(9):1245-52.

Lee et al., An allosteric self-splicing ribozyme triggered by a bacterial second messenger. Science. Aug. 13, 2010;329(5993):845-8. doi: 10.1126/science.1190713.

Lee et al., Failure to detect DNA-guided genome editing using Natronobacterium gregoryi Argonaute. Nat Biotechnol. Nov. 28, 2016;35(1):17-18. doi: 10.1038/nbt.3753.

Lee et al., Group I Intron-Based Therapeutics Through Trans-Splicing Reaction. Prog Mol Biol Transl Sci. 2018;159:79-100. doi: 10.1016/bs.pmbts.2018.07.001. Epub Aug. 9, 2018.

Lee et al., PIK3CA gene is frequently mutated in breast carcinomas and hepatocellular carcinomas. Oncogene. Feb. 17, 2005;24(8):1477-80.

Lee et al., Recognition of liposomes by cells: in vitro binding and endocytosis mediated by specific lipid headgroups and surface charge density. Biochim Biophys Acta. Jan. 31, 1992;1103(2):185-97.

Lee et al., Ribozyme Mediated gRNA Generation for In Vitro and In Vivo CRISPR/Cas9 Mutagenesis. PLoS One. Nov. 10, 2016;11(11):e0166020. doi: 10.1371/journal.pone.0166020. eCollection 2016.

Lee et al., Simultaneous targeting of linked loci in mouse embryos using base editing. Sci Rep. Feb. 7, 2019;9(1):1662. doi: 10.1038/s41598-018-33533-5.

Lee et al., Site-specific integration of mycobacteriophage L5: integration-proficient vectors for *Mycobacterium smegmatis, Mycobacterium tuberculosis*, and bacille Calmette-Guérin. Proc Natl Acad Sci U S A. Apr. 15, 1991;88(8):3111-5. doi: 10.1073/pnas.88.8.3111.

Lee et al., Synthetically modified guide RNA and donor DNA are a versatile platform for CRISPR-Cas9 engineering. Elife. May 2, 2017;6:e25312. doi: 10.7554/eLife.25312.

Lee et al., Targeted chromosomal deletions in human cells using zinc finger nucleases. Genome Res. Jan. 20, 2010: 81-89; Published in Advance Dec. 1, 2009, doi:10.1101/gr.099747.109.

Lee et al., Targeting fidelity of adenine and cytosine base editors in mouse embryos. Nat Commun. Nov. 15, 2018;9(1):4804. doi: 10.1038/s41467-018-07322-7.

Lee et al., Transcriptional regulation and its misregulation in disease. Cell. Mar. 14, 2013;152(6):1237-51. doi: 10.1016/j.cell.2013.02.014.

Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.

Lei et al., Site-specificity of serine integrase demonstrated by the attB sequence preference of ?BT1 integrase. FEBS Lett. Apr. 2018;592(8):1389-1399. doi: 10.1002/1873-3468.13023. Epub Mar. 25, 2018.

Lemos et al., CRISPR/Cas9 cleavages in budding yeast reveal templated insertions and strandspecific insertion/deletion profiles.

(56) References Cited

OTHER PUBLICATIONS

Proc Natl Acad Sci U S A. Feb. 27, 2018;115(9):E2040-E2047. doi: 10.1073/pnas.1716855115. Epub Feb. 13, 2018.
Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.
Levy et al., Cytosine and adenine base editing of the brain, liver, retina, heart and skeletal muscle of mice via adeno-associated viruses. Nat Biomed Eng. 2020;4(1):97-110. doi:10.1038/s41551-019-0501-5.
Levy et al., Inhibition of calcification of bioprosthetic heart valves by local controlled-release diphosphonate. Science. Apr. 12, 1985;228(4696):190-2.
Levy et al., Membrane-associated guanylate kinase dynamics reveal regional and developmental specificity of synapse stability. J Physiol. Mar. 1, 2017;595(5):1699-1709. doi: 10.1113/JP273147. Epub Jan. 18, 2017.
Lew et al., Protein splicing in vitro with a semisynthetic two-component minimal intein. J Biol Chem. Jun. 26, 1998;273(26):15887-90. doi: 10.1074/jbc.273.26.15887.
Lewis et al., A serum-resistant cytofectin for cellular delivery of antisense oligodeoxynucleotides and plasmid DNA. Proc Natl Acad Sci U S A. Apr. 16, 1996;93(8):3176-81.
Lewis et al., Building the Class 2 CRISPR-Cas Arsenal. Mol Cell 2017;65(3);377-379.
Lewis et al., Codon 129 polymorphism of the human prion protein influences the kinetics of amyloid formation. J Gen Virol. Aug. 2006;87(Pt 8):2443-9.
Lewis et al., Cytosine deamination and the precipitous decline of spontaneous mutation during Earth's history. Proc Natl Acad Sci U S A. Jul. 1, 20169;113(29):8194-9. doi: 10.1073/pnas.1607580113. Epub Jul. 5, 2016.
Lewis et al., RNA modifications and structures cooperate to guide RNA-protein interactions. Nat Rev Mol Cell Biol. Mar. 2017;18(3):202-210. doi: 10.1038/nrm.2016.163. Epub Feb. 1, 2017.
Li et al., A Radioactivity-Based Assay for Screening Human m6A-RNA Methyltransferase, METTL3-METTL14 Complex, and Demethylase ALKBH5. J Biomol Screen. Mar. 2016;21(3):290-7. doi: 10.1177/1087057115623264. Epub Dec. 23, 2015.
Li et al., Base editing with a Cpf1-cytidine deaminase fusion. Nat Biotechnol. Apr. 2018;36(4):324-327. doi: 10.1038/nbt.4102. Epub Mar. 19, 2018.
Li et al., Current approaches for engineering proteins with diverse biological properties. Adv Exp Med Biol. 2007;620:18-33.
Li et al., Disruption of splicing-regulatory elements using CRISPR/Cas9 to rescue spinal muscular atrophy in human iPSCs and mice. National Science Review. Jan. 1, 2020:92-101. DOI: 10.1093/nsr/nwz131. Retrieved from the Internet via https://academic.oup.com/nsr/article-pdf/7/1/92/33321439/nwz131.pdf. Last accessed Apr. 28, 2021.
Li et al., Fast and accurate short read alignment with Burrows-Wheeler transform. Bioinformatics. Jul. 15, 2009;25(14):1754-60. doi: 10.1093/bioinformatics/btp324. Epub May 18, 2009.
Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.
Li et al., Highly efficient and precise base editing in discarded human tripronuclear embryos. Protein Cell. Aug. 19, 2017. doi: 10.1007/s13238-017-0458-7. [Epub ahead of print].
Li et al., Lagging strand DNA synthesis at the eukaryotic replication fork involves binding and stimulation of FEN-1 by proliferating cell nuclear antigen. J Biol Chem. Sep. 22, 1995;270(38):22109-12. doi: 10.1074/jbc.270.38.22109.
Li et al., Loss of post-translational modification sites in disease. Pac Symp Biocomput. 2010:337-47. doi: 10.1142/9789814295291_0036.
Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.
Li et al., Multiplex and homologous recombination-mediated genome editing in *Arabidopsis* and Nicotiana benthamiana using guide RNA and Cas9. Nat Biotechnol. Aug. 2013;31(8):688-91. doi: 10.1038/nbt.2654.
Li et al., Protein trans-splicing as a means for viral vector-mediated in vivo gene therapy. Hum Gene Ther. Sep. 2008;19(9):958-64. doi: 10.1089/hum.2008.009.
Li et al., RSEM: accurate transcript quantification from RNA-Seq data with or without a reference genome. BMC Bioinformatics. Aug. 4, 2011;12:323. doi: 10.1186/1471-2105-12-323.
Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.
Li, Mechanisms and functions of DNA mismatch repair. Cell Res. Jan. 2008;18(1):85-98. doi: 10.1038/cr.2007.115.
Liang et al., Correction of ?-thalassemia mutant by base editor in human embryos. Protein Cell. Nov. 2017;8(11):811-822. doi: 10.1007/s13238-017-0475-6. Epub Sep. 23, 2017.
Liang et al., Homology-directed repair is a major double-strand break repair pathway in mammalian cells. Proc Natl Acad Sci U S A. Apr. 28, 1998;95(9):5172-7. doi: 10.1073/pnas.95.9.5172.
Liang et al., Rapid and highly efficient mammalian cell engineering via Cas9 protein transfection. Send to; J Biotechnol. Aug. 20, 2015;208:44-53. doi: 10.1016/j.jbiotec.2015.04.024.
Lieber et al., Mechanism and regulation of human non-homologous DNA end-joining. Nat Rev Mol Cell Biol. Sep. 2003;4(9):712-20.
Lienert et al., Two- and three-input TALE-based AND logic computation in embryonic stem cells. Nucleic Acids Res. Nov. 2013;41(21):9967-75. doi: 10.1093/nar/gkt758. Epub Aug. 27, 2013.
Lilley, D.M. The Varkud Satellite Ribozyme. RNA. Feb. 2004;10(2):151-8.doi: 10.1261/rna.5217104.
Lim et al., Crystal structure of the moloney murine leukemia virus RNase H domain. J Virol. Sep. 2006;80(17):8379-89. doi: 10.1128/JVI.00750-06.
Lin et al., Enhanced homology-directed human genome engineering by controlled timing of CRISPR/Cas9 delivery. Elife. Dec. 15, 2014;3:e04766. doi: 10.7554/eLife.04766.
Lin et al., Prime genome editing in rice and wheat. Nat Biotechnol. May 2020;38(5):582-585. doi: 10.1038/s41587-020-0455-x. Epub Mar. 16, 2020.
Lin et al., The human REV1 gene codes for a DNA template-dependent dCMP transferase. Nucleic Acids Res. Nov. 15, 1999;27(22):4468-75. doi: 10.1093/nar/27.22.4468.
Link et al., Engineering ligand-responsive gene-control elements: lessons learned from natural riboswitches. Gene Ther. Oct. 2009;16(10):1189-201. doi: 10.1038/gt.2009.81. Epub Jul. 9, 2009. Review.
Liu et al., C2c1-sgRNA Complex Structure Reveals RNA-Guided DNA Cleavage Mechanism. Molecular Cell Jan. 2017;65(2):310-22.
Liu et al., Split dnaE genes encoding multiple novel inteins in Trichodesmium erythraeum. J Biol Chem. Jul. 18, 2003;278(29):26315-8. doi: 10.1074/jbc.C300202200. Epub May 24, 2003.
Liu et al., A METTL3-METTL14 complex mediates mammalian nuclear RNA N6-adenosine methylation. Nat Chem Biol. Feb. 2014;10(2):93-5. doi: 10.1038/nchembio.1432. Epub Dec. 6, 2013.
Liu et al., Adding new chemistries to the genetic code. Annu Rev Biochem. 2010;79:413-44. doi: 10.1146/annurev.biochem.052308.105824.
Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.
Liu et al., Balancing AID and DNA repair during somatic hypermutation. Trends Immunol. Apr. 2009;30(4):173-81. doi: 10.1016/j.it.2009.01.007.
Liu et al., Calcineurin is a common target of cyclophilin-cyclosporin A and FKBP-FK506 complexes. Cell. Aug. 23, 1991;66(4):807-15. doi: 10.1016/0092-8674(91)90124-h.

(56) References Cited

OTHER PUBLICATIONS

Liu et al., CasX enzymes comprise a distinct family of RNA-guided genome editors. Nature. Feb. 2019;566(7743):218-223. doi: 10.1038/s41586-019-0908-x. Epub Feb. 4, 2019. Author manuscript entitled CRISPR-CasX is an RNA-dominated enzyme active for human genome editing.
Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.
Liu et al., Computational approaches for effective CRISPR guide RNA design and evaluation. Comput Struct Biotechnol J. Nov. 29, 2019;18:35-44. doi: 10.1016/j.csbj.2019.11.006.
Liu et al., Design of polydactyl zinc-finger proteins for unique addressing within complex genomes. Proc Natl Acad Sci U S A. May 27, 1997;94(11):5525-30.
Liu et al., Direct Promoter Repression by BCL11A Controls the Fetal to Adult Hemoglobin Switch. Cell. Apr. 5, 2018;173(2):430-442.e17. doi: 10.1016/j.cell.2018.03.016. Epub Mar. 29, 2018.
Liu et al., Distance determination by GIY-YIG intron endonucleases: discrimination between repression and cleavage functions. Nucleic Acids Res. Mar. 31, 2006;34(6):1755-64. Print 2006.
Liu et al., Editing DNA Methylation in the Mammalian Genome. Cell. Sep. 22, 2016;167(1):233-247.e17. doi: 10.1016/j.cell.2016.08.056.
Liu et al., Engineering a tRNA and aminoacyl-tRNA synthetase for the site-specific incorporation of unnatural amino acids into proteins in vivo. Proc Natl Acad Sci U S A. Sep. 16, 1997;94(19):10092-7.
Liu et al., Fast Colorimetric Sensing of Adenosine and Cocaine Based on a General Sensor Design Involving Aptamers and Nanoparticles. Angew Chem. Dec. 16, 2006;45(1):90-4. DOI: 10.1002/anie.200502589.
Liu et al., Fast Colorimetric Sensing of Adenosine and Cocaine Based on a General Sensor Design Involving Aptamers and Nanoparticles. Angew Chem. 2006;118(1):96-100.
Liu et al., Flap endonuclease 1: a central component of DNA metabolism. Annu Rev Biochem. 2004;73:589-615. doi: 10.1146/annurev.biochem.73.012803.092453.
Liu et al., Functional Nucleic Acid Sensors. Chem Rev. May 2009;109(5):1948-98. doi: 10.1021/cr030183i.
Liu et al., Genetic incorporation of unnatural amino acids into proteins in mammalian cells. Nat Methods. Mar. 2007;4(3):239-44. Epub Feb. 25, 2007.
Liu et al., Highly efficient RNA-guided base editing in rabbit. Nat Commun. Jul. 13, 2018;9(1):2717. doi: 10.1038/s41467-018-05232-2.
Liu et al., N(6)-methyladenosine-dependent RNA structural switches regulate RNA-protein interactions. Nature. Feb. 26, 2015;518(7540):560-4. doi: 10.1038/nature14234.
Liu et al., Probing N6-methyladenosine RNA modification status at single nucleotide resolution in mRNA and long noncoding RNA. RNA. Dec. 2013;19(12):1848-56. doi: 10.1261/rna.041178.113. Epub Oct. 18, 2013.
Liu et al., Reverse transcriptase of foamy virus. Purification of the enzymes and immunological identification. Arch Virol. 1977;55(3):187-200. doi: 10.1007/BF01319905.
Liu et al., Reverse transcriptase-mediated tropism switching in Bordetella bacteriophage. Science. Mar. 15, 2002;295(5562):2091-4. doi: 10.1126/science.1067467.
Liu et al., *Saccharomyces cerevisiae* flap endonuclease 1 uses flap equilibration to maintain triplet repeat stability. Mol Cell Biol. May 2004;24(9):4049-64. doi: 10.1128/MCB.24.9.4049-4064.2004.
Liu et al., The Molecular Architecture for RNA-Guided RNA Cleavage by Cas13a. Cell. Aug. 10, 2017;170(4):714-726.e10. doi: 10.1016/j.cell.2017.06.050. Epub Jul. 27, 2017.
Loessner et al., Complete nucleotide sequence, molecular analysis and genome structure of bacteriophage A118 of Listeria monocytogenes: implications for phage evolution. Mol Microbiol. Jan. 2000;35(2):324-40. doi: 10.1046/j.1365-2958.2000.01720.x.
Lombardo et al., Gene editing in human stem cells using zinc finger nucleases and integrase-defective lentiviral vector delivery. Nat Biotechnol. Nov. 2007;25(11):1298-306. Epub Oct. 28, 2007.
Long et al., Postnatal genome editing partially restores dystrophin expression in a mouse model of muscular dystrophy. Science. Jan. 22, 2016;351(6271):400-3. doi: 10.1126/science.aad5725. Epub Dec. 31, 2015.
Lopez-Girona et al., Cereblon is a direct protein target for immunomodulatory and antiproliferative activities of lenalidomide and pomalidomide. Leukemia. Nov. 2012;26(11):2326-35. doi: 10.1038/leu.2012.119. Epub May 3, 2012.
Lorenz et al., ViennaRNA Package 2.0. Algorithms Mol Biol. Nov. 24, 2011;6:26. doi: 10.1186/1748-7188-6-26.
Losey et al., Crystal structure of Staphylococcus sureus tRNA adenosine deaminase tadA in complex with RNA. Nature Struct. Mol. Biol. Feb. 2006;13(2):153-9.
Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.
Luan et al., Reverse transcription of R2Bm RNA is primed by a nick at the chromosomal target site: a mechanism for non-LTR retrotransposition. Cell. Feb. 26, 1993;72(4):595-605. doi: 10.1016/0092-8674(93)90078-5.
Luckow et al., High level expression of nonfused foreign genes with Autographa califomica nuclear polyhedrosis virus expression vectors. Virology. May 1989;170(1):31-9. doi: 10.1016/0042-6822(89)90348-6.
Lukacsovich et al., Repair of a specific double-strand break generated within a mammalian chromosome by yeast endonuclease I-SceI. Nucleic Acids Res. Dec. 25, 1994;22(25):5649-57. doi: 10.1093/nar/22.25.5649.
Lüke et al., Partial purification and characterization of the reverse transcriptase of the simian immunodeficiency virus TYO-7 isolated from an African green monkey. Biochemistry. Feb. 20, 1990;29(7):1764-9. doi: 10.1021/bi00459a015.
Lundberg et al., Delivery of short interfering RNA using endosomolytic cell-penetrating peptides. FASEB J. Sep. 2007;21(11):2664-71. Epub Apr. 26, 2007.
Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19.
Lynch, Evolution of the mutation rate. Trends Genet. Aug. 2010;26(8):345-52. doi: 10.1016/j.tig.2010.05.003. Epub Jun. 30, 2010.
Lyons et al., Efficient Recognition of an Unpaired Lesion by a DNA Repair Glycosylase. J. Am. Chem. Soc., 2009;131(49):17742-3. DOI: 10.1021/ja908378y.
Ma et al., Identification of pseudo attP sites for phage phiC31 integrase in bovine genome. Biochem Biophys Res Commun. Jul. 7, 2006;345(3):984-8. doi: 10.1016/j.bbrc.2006.04.145. Epub May 3, 2006.
Ma et al., In vitro protein engineering using synthetic tRNA(Ala) with different anticodons. Biochemistry. Aug. 10, 1993;32(31):7939-45.
Ma et al., PhiC31 integrase induces efficient site-specific recombination in the Capra hircus genome. DNA Cell Biol. Aug. 2014;33(8):484-91. doi: 10.1089/dna.2013.2124. Epub Apr. 22, 2014.
Ma et al., Single-Stranded DNA Cleavage by Divergent CRISPR-Cas9 Enzymes. Mol Cell. Nov. 5, 2015;60(3):398-407. doi: 10.1016/j.molcel.2015.10.030.
Ma et al., Targeted AID-mediated mutagenesis (TAM) enables efficient genomic diversification in mammalian cells. Nature Methods. Oct. 2016;13:1029-35. doi:10.1038/nmeth.4027.
Maas et al., Identification and characterization of a human tRNA-specific adenosine deaminase related to the ADAR family of pre-mRNA editing enzymes. Proc Natl Acad Sci U S A. Aug. 3, 1999;96(16):8895-900. doi: 10.1073/pnas.96.16.8895.
Macbeth et al., Inositol hexakisphosphate is bound in the ADAR2 core and required for RNA editing. Science. Sep. 2, 2005;309(5740):1534-9. doi: 10.1126/science.1113150.

(56) References Cited

OTHER PUBLICATIONS

Macrae et al., Ribonuclease revisited: structural insights into ribonuclease III family enzymes. Curr Opin Struct Biol. Feb. 2007;17(1):138-45. doi: 10.1016/j.sbi.2006.12.002. Epub Dec. 27, 2006.
Maeder et al., CRISPR RNA-guided activation of endogenous human genes. Nat Methods. Oct. 2013;10(10):977-9. doi: 10.1038/nmeth.2598. Epub Jul. 25, 2013.
Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.
Maeder et al., Robust, synergistic regulation of human gene expression using TALE activators. Nat Methods. Mar. 2013;10(3):243-5. doi: 10.1038/nmeth.2366. Epub Feb. 10, 2013.
Magin et al., Corf, the Rev/Rex homologue of HTDV/HERV-K, encodes an arginine-rich nuclear localization signal that exerts a trans-dominant phenotype when mutated. Virology. Aug. 15, 2000;274(1):11-6. doi: 10.1006/viro.2000.0438.
Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.
Maji et al., A High-Throughput Platform to Identify Small-Molecule Inhibitors of CRISPR-Cas9. Cell. May 2, 2019;177(4):1067-1079.e19. doi: 10.1016/j.cell.2019.04.009.
Makarova et al., Prokaryotic homologs of Argonaute proteins are predicted to function as key components of a novel system of defense against mobile genetic elements. Biology Direct 2009;4:29.
Makarova et al., An updated evolutionary classification of CRISPR-Cas systems. Nat Rev Microbiol. Nov. 2015;13(11):722-36. doi: 10.1038/nrmicro3569. Epub Sep. 28, 2015.
Makarova et al., Classification and Nomenclature of CRISPR-Cas Systems: Where from Here? Crispr J. Oct. 2018;1(5):325-336. doi: 10.1089/crispr.2018.0033.
Makarova et al., Evolution and classification of the CRISPR-Cas systems. Nat Rev Microbiol. Jun. 2011;9(6):467-77. doi: 10.1038/nrmicro2577. Epub May 9, 2011.
Makeyev et al., Evolutionary potential of an RNA virus. J Virol. Feb. 2004;78(4):2114-20.
Malashkevich et al., Crystal structure of tRNA adenosine deaminase TadA from *Escherichia coli*. Deposited: Mar. 10, 2005 Released: Feb. 21, 2006 doi:10.2210/pdblz3a/pdb (2006).
Mali et al., Cas9 as a versatile tool for engineeringbiology. Nat Methods. Oct. 2013;10(10):957-63. doi: 10.1038/nmeth.2649.
Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.
Mali et al., RNA-guided human genome engineering via Cas9. Science. Feb. 15, 2013;339(6121):823-6. doi: 10.1126/science.1232033. Epub Jan. 3, 2013.
Malito et al., Structural basis for lack of toxicity of the diphtheria toxin mutant CRM197. Proc Natl Acad Sci U S A. Apr. 3, 2012;109(14):5229-34. doi: 10.1073/pnas.1201964109. Epub Mar. 19, 2012.
Mandal et al., Efficient ablation of genes in human hematopoietic stem and effector cells using CRISPR/Cas9. Cell Stem Cell. Nov. 6, 2014;15(5):643-52. doi: 10.1016/j.stem.2014.10.004. Epub Nov. 6, 2014.
Mandal et al., Riboswitches Control Fundamental Biochemical Pathways in Bacillus Subtilis and Other Bacteria. Cell. May 30, 2003;113(5):577-86. doi: 10.1016/s0092-8674(03)00391-x.
Mani et al., Design, engineering, and characterization of zinc finger nucleases. Biochem Biophys Res Commun. Sep. 23, 2005;335(2):447-57.
Marceau, Functions of single-strand DNA-binding proteins in DNA replication, recombination, and repair. Methods Mol Biol. 2012;922:1-21. doi: 10.1007/978-1-62703-032-8_1.
Maresca et al., Obligate ligation-gated recombination (ObLiGaRe): custom-designed nuclease-mediated targeted integration through nonhomologous end joining. Genome Res. Mar. 2013;23(3):539-46. Doi: 10.1101/gr.145441.112. Epub Nov. 14, 2012.
Marioni et al., DNA methylation age of blood predicts all-cause mortality in later life. Genome Biol. Jan. 30, 2015;16:25. doi: 10.1186/s13059-015-0584-6.
Marrafhini et al., CRISPR interference limits horizontal gene transfer in staphylococci by targeting DNA. Science. Dec. 19, 2008;322(5909):1843-5. doi: 10.1126/science.1165771.
Martinez et al., Hypermutagenesis of RNA using human immunodeficiency virus type 1 reverse transcriptase and biased dNTP concentrations. Proc Natl Acad Sci U S A. Dec. 6, 1994;91(25):11787-91. doi: 10.1073/pnas.91.25.11787.
Martsolf et al., Complete trisomy 17p a relatively new syndrome. Ann Genet. 1988;31(3):172-4.
Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.
Mascola et al., HIV-1 neutralizing antibodies: understanding nature's pathways. Immunol Rev. Jul. 2013;254(1):225-44. doi: 10.1111/imr.12075.
Mathys et al., Characterization of a self-splicing mini-intein and its conversion into autocatalytic N- and C-terminal cleavage elements: facile production of protein building blocks for protein ligation. Gene. Apr. 29, 1999;231(1-2):1-13. doi: 10.1016/s0378-1119(99)00103-1.
Matsuura et al., A gene essential for the site-specific excision of actinophage r4 prophage genome from the chromosome of a lysogen. J Gen Appl Microbiol. 1995;41(1):53-61.
Matthews, Structures of human ADAR2 bound to dsRNA reveal base-flipping mechanism and basis for site selectivity. Nat Struct Mol Biol. May 2016;23(5):426-33. doi: 10.1038/nsmb.3203. Epub Apr. 11, 2016.
May et al., Emergent lineages of mumps virus suggest the need for a polyvalent vaccine. Int J Infect Dis. Jan. 2018;66:1-4. doi: 10.1016/j.ijid.2017.09.024. Epub Oct. 4, 2017.
McCarroll et al., Copy-number variation and association studies of human disease. Nat Genet. Jul. 2007;39(7 Suppl):S37-42. doi: 10.1038/ng2080.
McDonald et al., Characterization of mutations at the mouse phenylalanine hydroxylase locus. Genomics. Feb. 1, 1997;39(3):402-5. doi: 10.1006/geno.1996.4508.
Mcinerney et al., Error Rate Comparison during Polymerase Chain Reaction by DNA Polymerase. Mol Biol Int. 2014;2014:287430. doi: 10.1155/2014/287430. Epub Aug. 17, 2014.
Mckenna et al., Recording development with single cell dynamic lineage tracing. Development. Jun. 27, 2019;146(12):dev169730. doi: 10.1242/dev.169730.
Mckenna et al., Whole-organism lineage tracing by combinatorial and cumulative genome editing. Science. Jul. 29, 2016;353(6298):aaf7907. doi: 10.1126/science.aaf7907. Epub May 26, 2016.
Mcvey et al., MMEJ repair of double-strand breaks (director's cut): deleted sequences and alternative endings. Trends Genet. Nov. 2008;24(11):529-38. doi: 10.1016/j.tig.2008.08.007. Epub Sep. 21, 2008.
Mead et al., A novel protective prion protein variant that colocalizes with kuru exposure. N Engl J Med. Nov. 19, 2009;361(21):2056-65. doi: 10.1056/NEJMoa0809716.
Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.
Meinke et al., Cre Recombinase and Other Tyrosine Recombinases. Chem Rev. Oct. 26, 2016;116(20):12785-12820. doi: 10.1021/acs.chemrev.6b00077. Epub May 10, 2016.
Menéndez-Arias, Mutation rates and intrinsic fidelity of retroviral reverse transcriptases. Viruses. Dec. 2009;1(3):1137-65. doi: 10.3390/v1031137. Epub Dec. 4, 2009.
Meng et al., Targeted gene inactivation in zebrafish using engineered zinc-finger nucleases. Nat Biotechnol. Jun. 2008;26(6):695-701. doi: 10.1038/nbt1398. Epub May 25, 2008.

(56) References Cited

OTHER PUBLICATIONS

Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.
Mertens et al., Site-specific recombination in bacteriophage Mu: characterization of binding sites for the DNA invertase Gin. EMBO J. Apr. 1988;7(4):1219-27.
Meyer et al., Breathing life into polycations: functionalization with pH-responsive endosomolytic peptides and polyethylene glycol enables siRNA delivery. J Am Chem Soc. Mar. 19, 2008;130(11):3272-3. doi: 10.1021/ja710344v. Epub Feb. 21, 2008.
Meyer et al., Comprehensive analysis of mRNA methylation reveals enrichment in 3' UTRs and near stop codons. Cell. Jun. 22, 2012;149(7):1635-46. doi: 10.1016/j.cell.2012.05.003. Epub May 17, 2012.
Meyer et al., Confirmation of a second natural preQ1 aptamer class in Streptococcaceae bacteria. RNA. Apr. 2008;14(4):685-95. doi: 10.1261/rna.937308. Epub Feb. 27, 2008.
Meyer et al., Library generation by gene shuffling. Curr Protoc Mol Biol. Jan. 6, 2014;105:Unit 15.12.. doi: 10.1002/0471142727.mb1512s105.
Meyer et al., The dynamic epitranscriptome: N6-methyladenosine and gene expression control. Nat Rev Mol Cell Biol. May 2014;15(5):313-26. doi: 10.1038/nrm3785. Epub Apr. 9, 2014.
Michel et al., Mitochondrial class II introns encode proteins related to the reverse transcriptases of retroviruses. Nature. Aug. 15-21, 1985;316(6029):641-3. doi: 10.1038/316641a0.
Midoux et al., Chemical vectors for gene delivery: a current review on polymers, peptides and lipids containing histidine or imidazole as nucleic acids carriers. Br J Pharmacol. May 2009;157(2):166-78. doi: 10.1111/j.1476-5381.2009.00288.x.
Mihai et al., PTEN inhibition improves wound healing in lung epithelia through changes in cellular mechanics that enhance migration. Am J Physiol Lung Cell Mol Physiol. 2012;302(3):L287-L299.
Mijakovic et al., Bacterial single-stranded DNA-binding proteins are phosphorylated on tyrosine. Nucleic Acids Res. Mar. 20, 2006;34(5):1588-96. doi: 10.1093/nar/gkj514.
Miller et al., A TALE nuclease architecture for efficient genome editing. Nat Biotechnol. Feb. 2011;29(2):143-8. doi:10.1038/nbt.1755. Epub Dec. 22, 2010.
Miller et al., An improved zinc-finger nuclease architecture for highly specific genome editing. Nat Biotechnol. Jul. 2007;25(7):778-85. Epub Jul. 1, 2007.
Miller et al., Construction and properties of retrovirus packaging cells based on gibbon ape leukemia virus. J Virol. May 1991;65(5):2220-4. doi: 10.1128/JVI.65.5.2220-2224.1991.
Miller et al., Continuous evolution of SpCas9 variants compatible with non-G PAMs. Nat Biotechnol. Apr. 2020;38(4):471-481. doi: 10.1038/s41587-020-0412-8. Epub Feb. 10, 2020.
Miller, Human gene therapy comes of age. Nature. Jun. 11, 1992;357(6378):455-60. doi: 10.1038/357455a0.
Mills et al., Protein splicing in trans by purified N- and C-terminal fragments of the *Mycobacterium tuberculosis* RecA intein. Proc Natl Acad Sci U S A. Mar. 31, 1998;95(7):3543-8. doi: 10.1073/pnas.95.7.3543.
Minoche et al., Evaluation of genomic high-throughput sequencing data generated on Illumina HiSeq and genome analyzer systems. Genome Biol. Nov. 8, 2011;12(11):R112. doi: 10.1186/GB-2011-12-11-r112.
Minoretti et al., A W148R mutation in the human FOXD4 gene segregating with dilated cardiomyopathy, obsessive-compulsive disorder, and suicidality. Int J Mol Med. Mar. 2007;19(3):369-72.
Mir et al., Two Active Site Divalent Ions in the Crystal Structure of the Hammerhead Ribozyme Bound to a Transition State Analogue. Biochemistry. . Feb. 2, 2016;55(4):633-6. doi: 10.1021/acs.biochem.5b01139. Epub Jan. 19, 2016.
Mishina et al., Conditional gene targeting on the pure C57BL/6 genetic background. Neurosci Res. Jun. 2007;58(2):105-12. doi: 10.1016/j.neures.2007.01.004. Epub Jan. 18, 2007.
Mitani et al., Delivering therapeutic genes—matching approach and application. Trends Biotechnol. May 1993;11(5):162-6. doi: 10.1016/0167-7799(93)90108-L.
Mitton-Fry et al., Poly(A) tail recognition by a viral RNA element through assembly of a triple helix. Science. Nov. 26, 2010;330(6008):1244-7. doi: 10.1126/science.1195858.
Miyaoka et al., Systematic quantification of HDR and NHEJ reveals effects of locus, nuclease, and cell type on genome-editing. Sci Rep. Mar. 31, 2016;6:23549. doi: 10.1038/srep23549.
Moede et al., Identification of a nuclear localization signal, RRMKWKK, in the homeodomain transcription factor PDX-1. FEBS Lett. Nov. 19, 1999;461(3):229-34. doi: 10.1016/s0014-5793(99)01446-5.
Mohr et al., A Reverse Transcriptase-Casl Fusion Protein Contains a Cas6 Domain Required for Both CRISPR RNA Biogenesis and RNA Spacer Acquisition. Mol Cell. Nov. 15, 2018;72(4):700-714.e8. doi: 10.1016/j.molcel.2018.09.013. Epub Oct. 18, 2018. Including Supplemental Information.
Mohr et al., Thermostable group II intron reverse transcriptase fusion proteins and their use in cDNA synthesis and next-generation RNA sequencing. RNA. Jul. 2013;19(7):958-70. doi: 10.1261/rna.039743.113. Epub May 22, 2013.
Mojica et al., Intervening sequences of regularly spaced prokaryotic repeats derive from foreign genetic elements. J Mol Evol. Feb. 2005;60(2):174-82.
Mol et al., Crystal structure and mutational analysis of human uracil-DNA glycosylase: structural basis for specificity and catalysis. Cell. Mar. 24, 1995;80(6):869-78. doi: 10.1016/0092-8674(95)90290-2.
Mol et al., Crystal structure of human uracil-DNA glycosylase in complex with a protein inhibitor: protein mimicry of DNA. Cell. Sep. 8, 1995;82(5):701-8.
Molla et al., CRISPR/Cas-Mediated Base Editing: Technical Considerations and Practical Applications. Trends Biotechnol. Oct. 2019;37(10):1121-1142. doi: 10.1016/j.tibtech.2019.03.008. Epub Apr. 14, 2019.
Monahan et al., Site-specific incorporation of unnatural amino acids into receptors expressed in Mammalian cells. Chem Biol. Jun. 2003;10(6):573-80.
Monot et al., The specificity and flexibility of 11 reverse transcription priming at imperfect T-tracts. PLoS Genet. May 2013;9(5):e1003499. doi: 10.1371/journal.pgen.1003499. Epub May 9, 2013.
Montange et al., Structure of the S-adenosylmethionine riboswitch regulatory mRNA element. Nature. Jun. 29, 2006;441(7097):1172-5.
Moore et al., Improved somatic mutagenesis in zebrafish using transcription activator-like effector nucleases (TALENs). PloS One. 2012;7(5):e37877. Doi: 10.1371/journal.pone.0037877. Epub May 24, 2012.
Mootz et al., Conditional protein splicing: a new tool to control protein structure and function in vitro and in vivo. J Am Chem Soc. Sep. 3, 2003;125(35):10561-9.
Mootz et al., Protein splicing triggered by a small molecule. J Am Chem Soc. Aug. 7, 2002;124(31):9044-5.
Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.
Morita et al., The site-specific recombination system of actinophage TG1. FEMS Microbiol Lett. Aug. 2009;297(2):234-40. doi: 10.1111/j.1574-6968.2009.01683.x.
Morris et al., A peptide carrier for the delivery of biologically active proteins into mammalian cells. Nat Biotechnol. Dec. 2001;19(12):1173-6.
Moscou et al., A simple cipher governs DNA recognition by TAL effectors. Science. Dec. 11, 2009;326(5959):1501. doi: 10.1126/science.1178817.
Muir et al., Expressed protein ligation: a general method for protein engineering. Proc Natl Acad Sci U S A. Jun. 9, 1998;95(12):6705-10. doi: 10.1073/pnas.95.12.6705.
Muller et al., Nucleotide exchange and excision technology (NExT) DNA shuffling: a robust method for DNA fragmentation and directed evolution. Nucleic Acids Res. Aug. 1, 2005;33(13):e117. doi: 10.1093/nar/gni116. PMID: 16061932; PMCID: PMC1182171.

(56) References Cited

OTHER PUBLICATIONS

Mullins et al., Transgenesis in nonmurine species. Hypertension. Oct. 1993;22(4):630-3.
Mumtsidu et al., Structural features of the single-stranded DNA-binding protein of Epstein-Barr virus. J Struct Biol. Feb. 2008;161(2):172-87. doi: 10.1016/j.jsb.2007.10.014. Epub Nov. 1, 2007.
Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.
Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.
Muzyczka et al., Adeno-associated virus (AAV) vectors: will they work? J Clin Invest. Oct. 1994;94(4):1351. doi: 10.1172/JCI117468.
Myerowitz et al., The major defect in Ashkenazi Jews with Tay-Sachs disease is an insertion in the gene for the alpha-chain of beta-hexosaminidase. J Biol Chem. Dec. 15, 1988;263(35):18587-9.
Myers et al., Insulin signal transduction and the IRS proteins. Annu Rev Pharmacol Toxicol. 1996;36:615-58. doi: 10.1146/annurev.pa.36.040196.003151.
Nabel et al., Direct gene transfer for immunotherapy and immunization. Trends Biotechnol. May 1993;11(5):211-5. doi: 10.1016/0167-7799(93)90117-R.
Nahar et al., A G-quadruplex motif at the 3' end of sgRNAs improves CRISPR-Cas9 based genome editing efficiency. Chem Commun (Camb). Mar. 7, 2018;54(19):2377-2380. doi: 10.1039/c7cc08893k. Epub Feb. 16, 2018.
Nahvi et al., Coenzyme B12 riboswitches are widespread genetic control elements in prokaryotes. Nucleic Acids Res. Jan. 2, 2004;32(1):143-50.
Nakade et al., Microhomology-mediated end-joining-dependent integration of donor DNA in cells and animals using TALENs and CRISPR/Cas9. Nat Commun. Nov. 20, 2014;5:5560. doi: 10.1038/ncomms6560.
Nakamura et al., Codon usage tabulated from international DNA sequence databases: status for the year 2000. Nucleic Acids Res. Jan. 1, 2000;28(1):292. doi: 10.1093/nar/28.1.292.
Naorem et al., DGR mutagenic transposition occurs via hypermutagenic reverse transcription primed by nicked template RNA. Proc Natl Acad Sci U S A. Nov. 21, 2017;114(47):E10187-E10195. doi: 10.1073/pnas.1715952114. Epub Nov. 6, 2017.
Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.
Navaratnam et al., An overview of cytidine deaminases. Int J Hematol. Apr. 2006;83(3):195-200.
NCBI Reference Sequence: NM_002427.3. Wu et al., May 3, 2014. 5 pages.
Neel et al., Riboswitches: Classification, function and in silico approach, International Journal of Pharma Sciences and Research. 2010;1(9):409-420.
Nelson et al., Filamentous phage DNA cloning vectors: a noninfective mutant with a nonpolar deletion in gene III. Virology. 1981; 108(2): 338-50.
Nern et al., Multiple new site-specific recombinases for use in manipulating animal genomes. Proc Natl Acad Sci U S A. Aug. 23, 2011;108(34):14198-203. doi: 10.1073/pnas.1111704108. Epub Aug. 9, 2011.
Nguyen et al., Evolutionary drivers of thermoadaptation in enzyme catalysis. Science. Jan. 20, 2017;355(6322):289-294. doi: 10.1126/science.aah3717. Epub Dec. 22, 2016.
Nguyen et al., IQ-TREE: a fast and effective stochastic algorithm for estimating maximum-likelihood phylogenies. Mol Biol Evol. Jan. 2015;32(1):268-74. doi: 10.1093/molbev/msu300. Epub Nov. 3, 2014.
Ni et al., A PCSK9-binding antibody that structurally mimics the EGF(A) domain of LDL-receptor reduces LDL cholesterol in vivo. J Lipid Res. 2011;52:76-86.
Ni et al., Nucleic acid aptamers: clinical applications and promising new horizons. Curr Med Chem. 2011;18(27):4206-14. Review.
Nishida et al., Targeted nucleotide editing using hybrid prokaryotic and vertebrate adaptive immune systems. Science. Sep. 16, 2016;353(6305):1248. pii: aaf8729. doi: 10.1126/science.aaf8729. Epub Aug. 4, 2016.
Nishikura, Functions and regulation of RNA editing by ADAR deaminases. Annu Rev Biochem. 2010;79:321-349. doi:10.1146/annurev-biochem-060208-105251.
Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.
Nishimasu et al., Crystal Structure of *Staphylococcus aureus* Cas9. Cell. Aug. 27, 2015;162(5):1113-26. doi: 10.1016/j.cell.2015.08.007.
Nishimasu et al., Engineered CRISPR-Cas9 nuclease with expanded targeting space. Science. Sep. 21, 2018;361(6408):1259-1262. doi: 10.1126/science.aas9129. Epub Aug. 30, 2018.
Nomura et al., Controlling Mammalian Gene Expression by Allosteric Hepatitis Delta Virus Ribozymes. ACS Synth Biol. Dec. 20, 2013;2(12):684-9. doi: 10.1021/sb400037a. Epub May 22, 2013.
Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.
Noris et al., A phenylalanine-55 to serine amino-acid substitution in the human glycoprotein IX leucine-rich repeat is associated with Bernard-Soulier syndrome. Br J Haematol. May 1997;97(2):312-20.
Nottingham et al., RNA-seq of human reference RNA samples using a thermostable group II intron reverse transcriptase. RNA. Apr. 2016;22(4):597-613. doi: 10.1261/rna.055558.115. Epub Jan. 29, 2016.
Nowak et al., Characterization of single-stranded DNA-binding proteins from the psychrophilic bacteria *Desulfotalea psychrophila, Flavobacterium psychrophilum, Psychrobacter arcticus, Psychrobacter cryohalolentis, Psychromonas ingrahamii, Psychroflexus torquis*, and *Photobacterium profundum*. BMC Microbiol. Apr. 14, 2014;14:91. doi: 10.1186/1471-2180-14-91.
Nowak et al., Guide RNA Engineering for Versatile Cas9 Functionality. Nucleic Acids Res. Nov. 16, 2016;44(20):9555-9564. doi: 10.1093/nar/gkw908. Epub Oct. 12, 2016.
Nowak et al., Structural analysis of monomeric retroviral reverse transcriptase in complex with an RNA/DNA hybrid. Nucleic Acids Res. Apr. 1, 2013;41(6):3874-87. doi: 10.1093/nar/gkt053. Epub Feb. 4, 2013.
Numrych et al., A comparison of the effects of single-base and triple-base changes in the integrase arm-type binding sites on the site-specific recombination of bacteriophage lambda. Nucleic Acids Res. Jul. 11, 1990;18(13):3953-9. doi: 10.1093/nar/18.13.3953.
Nyerges et al., A highly precise and portable genome engineering method allows comparison of mutational effects across bacterial species. Proc Natl Acad Sci U S A. Mar. 1, 2016;113(9):2502-7. doi: 10.1073/pnas.1520040113. Epub Feb. 16, 2016.
Oakes et al., CRISPR-Cas9 Circular Permutants as Programmable Scaffolds for Genome Modification. Cell. Jan. 10, 2019;176(1-2):254-267.e16. doi: 10.1016/j.cell.2018.11.052.
Oakes et al., Profiling of engineering hotspots identifies an allosteric CRISPR-Cas9 switch. Nat Biotechnol. Jun. 2016;34(6):646-51. doi: 10.1038/nbt.3528. Epub May 2, 2016.
Oakes et al., Protein engineering of Cas9 for enhanced function. Methods Enzymol. 2014;546:491-511.
O'Connell et al., Programmable RNA recognition and cleavage by CRISPR/Cas9. Nature. Dec. 11, 2014;516(7530):263-6. doi: 10.1038/nature13769. Epub Sep. 28, 2014.
Odsbu et al., Specific N-terminal interactions of the *Escherichia coli* SeqA protein are required to form multimers that restrain negative supercoils and form foci. Genes Cells. Nov. 2005;10(11):1039-49.
Oeemig et al., Solution structure of DnaE intein from Nostoc punctiforme: structural basis for the design of a new split intein suitable for site-specific chemical modification. FEBS Lett. May 6, 2009;583(9):1451-6.

(56) References Cited

OTHER PUBLICATIONS

Offord, Advances in Genome Editing. The Scientist, Apr. 20, 2016. http://www.the-scientist.com/?articles.view/articleNo/45903/title/Advances-in-Genome-Editing/.
Oh et al., Positional cloning of a gene for Hermansky-Pudlak syndrome, a disorder of cytoplasmic organelles. Nat Genet. Nov. 1996;14(3):300-6. doi: 10.1038/ng1196-300.
Ohe et al., Purification and properties of xanthine dehydrogenase from Streptomyces cyanogenus. J Biochem. Jul. 1979;86(1):45-53.
Olivares et al., Site-specific genomic integration produces therapeutic Factor IX levels in mice. Nat Biotechnol. Nov. 2002;20(11):1124-8. doi: 10.1038/nbt753. Epub Oct. 15, 2002.
Olorunniji et al., Purification and In Vitro Characterization of Zinc Finger Recombinases. Methods Mol Biol. 2017;1642:229-245. doi: 10.1007/978-1-4939-7169-5_15.
Olorunniji et al., Site-specific recombinases: molecular machines for the Genetic Revolution. Biochem J. Mar. 15, 2016;473(6):673-84. doi: 10.1042/BJ20151112.
O'Maille et al., Structure-based combinatorial protein engineering (SCOPE). J Mol Biol. Aug. 23, 2002;321(4):677-91.
Orlando et al., Zinc-finger nuclease-driven targeted integration into mammalian genomes using donors with limited chromosomal homology. Nucleic Acids Res. Aug. 2010;38(15):e152. doi: 10.1093/nar/gkq512. Epub Jun. 8, 2010.
Orthwein et al., A mechanism for the suppression of homologous recombination in G1 cells. Nature. Dec. 17, 2015;528(7582):422-6. doi: 10.1038/nature16142. Epub Dec. 9, 2015.
Ortiz-Urda et al., Stable nonviral genetic correction of inherited human skin disease. Nat Med. Oct. 2002;8(10):1166-70. doi: 10.1038/nm766. Epub Sep. 16, 2002. Erratum in: Nat Med. Feb. 2003;9(2):237.
Osborn et al., Base Editor Correction of COL7A1 in Recessive Dystrophic Epidermolysis Bullosa Patient-Derived Fibroblasts and iPSCs. J Invest Dermatol. Feb. 2020;140(2):338-347.e5. doi: 10.1016/j.jid.2019.07.701. Epub Aug. 19, 2019.
Osborn et al., TALEN-based gene correction for epidermolysis bullosa. Mol Ther. Jun. 2013;21(6):1151-9. doi: 10.1038/mt.2013.56. Epub Apr. 2, 2013.
Ostermeier et al., A combinatorial approach to hybrid enzymes independent of DNA homology. Nat Biotechnol. Dec. 1999;17(12):1205-9.
Ostertag et al., Biology of mammalian L1 retrotransposons. Annu Rev Genet. 2001;35:501-38. doi: 10.1146/annurev.genet.35.102401.091032.
Otomo et al., Improved segmental isotope labeling of proteins and application to a larger protein. J Biomol NMR. Jun. 1999;14(2):105-14. doi: 10.1023/a:1008308128050.
Otomo et al., NMR observation of selected segments in a larger protein: central-segment isotope labeling through intein-mediated ligation. Biochemistry. Dec. 7, 1999;38(49):16040-4. doi: 10.1021/bi991902j.
Otto et al., The probability of fixation in populations of changing size. Genetics. Jun. 1997;146(2):723-33.
Packer et al., Methods for the directed evolution of proteins. Nat Rev Genet. Jul. 2015;16(7):379-94. doi: 10.1038/nrg3927. Epub Jun. 9, 2015.
Packer et al., Phage-assisted continuous evolution of proteases with altered substrate specificity. Nat Commun. Oct. 16, 2017;8(1):956. doi: 10.1038/s41467-017-01055-9.
Paige et al., RNA mimics of green fluorescent protein. Science. Jul. 29, 2011;333(6042):642-6. doi: 10.1126/science.1207339.
Paiva et al., Targeted protein degradation: elements of PROTAC design. Curr Opin Chem Biol. Jun. 2019;50:111-119. doi: 10.1016/j.cbpa.2019.02.022. Epub Apr. 17, 2019.
Pan et al., Biological and biomedical applications of engineered nucleases. Mol Biotechnol. Sep. 2013;55(1):54-62. doi: 10.1007/s12033-012-9613-9.
Paquet et al., Efficient introduction of specific homozygous and heterozygous mutations using CRISPR/Cas9. Nature. May 5, 2016;533(7601):125-9. doi: 10.1038/nature17664. Epub Apr. 27, 2016.
Park et al., Digenome-seq web tool for profiling CRISPR specificity. Nat Methods. May 30, 2017;14(6):548-549. doi: 10.1038/nmeth.4262.
Park et al., Highly efficient editing of the ?-globin gene in patient-derived hematopoietic stem and progenitor cells to treat sickle cell disease. Nucleic Acids Res. Sep. 5, 2019;47(15):7955-7972. doi: 10.1093/nar/gkz475.
Park et al., Sendai virus, an RNA virus with No. risk of genomic integration, delivers CRISPR/Cas9 for efficient gene editing. Mol Ther Methods Clin Dev. Aug. 24, 2016;3:16057. doi: 10.1038/mtm.2016.57.
Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.
Patel et al., Flap endonucleases pass 5'-flaps through a flexible arch using a disorder-thread-order mechanism to confer specificity for free 5'-ends. Nucleic Acids Res. May 2012;40(10):4507-19. doi: 10.1093/nar/gks051. Epub Feb. 8, 2012.
Pattanayak et al., Determining the specificities of TALENs, Cas9, and other genomeediting enzymes. Methods Enzymol. 2014;546:47-78. doi: 10.1016/978-0-12-801185-0.00003-9.
Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.
Pattanayak et al., Revealing off-target cleavage specificities of zinc-finger nucleases by in vitro selection. Nat Methods. Aug. 7, 2011;8(9):765-70. doi: 10.1038/nmeth.1670.
Pavletich et al., Zinc finger-DNA recognition: crystal structure of a Zif268-DNA complex at 2.1 A. Science. May 10, 1991;252(5007):809-17.
Pawson et al., Protein phosphorylation in signaling—50 years and counting. Trends Biochem Sci. Jun. 2005;30(6):286-90. doi: 10.1016/j.tibs.2005.04.013.
Pearl, Structure and function in the uracil-DNA glycosylase superfamily. Mutat Res. Aug. 30, 2000;460(3-4):165-81.
Peck et al., Directed evolution of a small-molecule-triggered intein with improved splicing properties in mammalian cells. Chem Biol. May 27, 2011;18(5):619-30. doi: 10.1016/j.chembiol.2011.02.014.
Pellenz et al., New human chromosomal safe harbor sites for genome engineering with CRISPR/Cas9, TAL effector and homing endonucleases. Aug. 20, 2018. bioRxiv doi: https://doi.org/10.1101/396390.
Pelletier, CRISPR-Cas systems for the study of the immune function. Nov. 15, 2016. https://doi.org/10.1002/9780470015902.a0026896.
Pennisi et al., The CRISPR craze. Science. Aug. 23, 2013;341(6148):833-6. doi: 10.1126/science.341.6148.833.
Pennisi et al., The tale of the TALEs. Science. Dec. 14, 2012;338(6113):1408-11. doi: 10.1126/science.338.6113.1408.
Perach et al., Catalytic features of the recombinant reverse transcriptase of bovine leukemia virus expressed in bacteria. Virology. Jun. 20, 1999;259(1):176-89. doi: 10.1006/viro.1999.9761.
Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.
Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.
Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.
Perler et al., Protein splicing and autoproteolysis mechanisms. Curr Opin Chem Biol. Oct. 1997;1(3):292-9. doi: 10.1016/s1367-5931(97)80065-8.
Perler et al., Protein splicing elements: inteins and exteins—a definition of terms and recommended nomenclature. Nucleic Acids Res. Apr. 11, 1994;22(7):1125-7. doi: 10.1093/nar/22.7.1125.
Perler, InBase, the New England Biolabs Intein Database. Nucleic Acids Res. Jan. 1, 1999;27(1):346-7. doi: 10.1093/nar/27.1.346.

(56) References Cited

OTHER PUBLICATIONS

Perler, Protein splicing of inteins and hedgehog autoproteolysis: structure, function, and evolution. Cell. Jan. 9, 1998;92(1):1-4. doi: 10.1016/s0092-8674(00)80892-2.
Petek et al., Frequent endonuclease cleavage at off-target locations in vivo. Mol Ther. May 2010;18(5):983-6. Doi: 10.1038/mt.2010.35. Epub Mar. 9, 2010.
Petersen-Mahrt et al., AID mutates *E. coli* suggesting a DNA deamination mechanism for antibody diversification. Nature. Jul. 4, 2002;418(6893):99-103.
Petolino et al., Editing Plant Genomes: a new era of crop improvement. Plant Biotechnol J. Feb. 2016;14(2):435-6. doi: 10.1111/pbi.12542.
Peyrottes et al., Oligodeoxynucleoside phosphoramidates (P-NH2): synthesis and thermal stability of duplexes with DNA and RNA targets. Nucleic Acids Res. May 15, 1996;24(10):1841-8.
Pfeiffer et al., Mechanisms of DNA double-strand break repair and their potential to induce chromosomal aberrations. Mutagenesis. Jul. 2000;15(4):289-302. doi: 10.1093/mutage/15.4.289.
Phillips, The challenge of gene therapy and DNA delivery. J Pharm Pharmacol. Sep. 2001;53(9):1169-74.
Pickart et al., Ubiquitin: structures, functions, mechanisms. Biochim Biophys Acta. Nov. 29, 2004;1695(1-3):55-72. doi: 10.1016/j.bbamcr.2004.09.019.
Pinkert et al., An albumin enhancer located 10 kb upstream functions along with its promoter to direct efficient, liver-specific expression in transgenic mice. Genes Dev. May 1987;1(3):268-76. doi: 10.1101/gad.1.3.268.
Pirakitikulr et al., PCRless library mutagenesis via oligonucleotide recombination in yeast. Protein Sci. Dec. 2010;19(12):2336-46. doi: 10.1002/pro.513.
Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.
Plosky et al., CRISPR-Mediated Base Editing without DNA Double-Strand Breaks. Mol Cell. May 19, 2016;62(4):477-8. doi: 10.1016/j.molcel.2016.05.006.
Pluciennik et al., PCNA function in the activation and strand direction of MutL? endonuclease in mismatch repair. Proc Natl Acad Sci U S A. Sep. 14, 2010;107(37):16066-71. doi: 10.1073/pnas.1010662107. Epub Aug. 16, 2010.
Poller et al., A leucine-to-proline substitution causes a defective alpha 1-antichymotrypsin allele associated with familial obstructive lung disease. Genomics. Sep. 1993;17(3):740-3.
Popp et al., Sortagging: a versatile method for protein labeling. Nat Chem Biol. Nov. 2007;3(11):707-8. doi: 10.1038/nchembio.2007.31. Epub Sep. 23, 2007.
Porteus, Design and testing of zinc finger nucleases for use in mammalian cells. Methods Mol Biol. 2008;435:47-61. doi: 10.1007/978-1-59745-232-8_4.
Posnick et al., Imbalanced base excision repair increases spontaneous mutation and alkylation sensitivity in *Escherichia coli*. J Bacteriol. Nov. 1999;181(21):6763-71.
Pospísilová et al., Hydrolytic cleavage of N6-substituted adenine derivatives by eukaryotic adenine and adenosine deaminases. Biosci Rep. 2008;28(6):335-347. doi:10.1042/BSR20080081.
Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.
Prasad et al., Rev1 is a base excision repair enzyme with 5'-deoxyribose phosphate lyase activity. Nucleic Acids Res. Dec. 15, 2016;44(22):10824-10833. doi: 10.1093/nar/gkw869. Epub Sep. 28, 2016.
Prashant et al., CAS9 transcriptional activators for target specificity screening and paired nickases for cooperative genome engineering. Nature Biotechnology 2013;31(9):833-8.
Prorocic et al., Zinc-finger recombinase activities in vitro. Nucleic Acids Res. Nov. 2011;39(21):9316-28. doi: 10.1093/nar/gkr652. Epub Aug. 17, 2011.
Proudfoot et al., Zinc finger recombinases with adaptable DNA sequence specificity. PLoS One. Apr. 29, 2011;6(4):e19537. doi: 10.1371/journal.pone.0019537.
Pruschy et al., Mechanistic studies of a signaling pathway activated by the organic dimerizer FK1012. Chem Biol. Nov. 1994;1(3):163-72. doi: 10.1016/1074-5521(94)90006-x.
Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.
Pu et al., Evolution of a split RNA polymerase as a versatile biosensor platform. Nat Chem Biol. Apr. 2017;13(4):432-438. doi: 10.1038/nchembio.2299. Epub Feb. 13, 2017.
Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.
Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.
Qi et al., Repurposing CRISPR as an RNA-guided platform for sequence-specific control of gene expression. Cell. Feb. 28, 2013;152(5):1173-83. doi: 10.1016/j.cell.2013.02.022.
Qu et al., Global mapping of binding sites for phic31 integrase in transgenic maden-darby bovine kidney cells using ChIP-seq. Hereditas. Jan. 14, 2019;156:3. doi: 10.1186/s41065-018-0079-z.
Queen et al., Immunoglobulin gene transcription is activated by downstream sequence elements. Cell. Jul. 1983;33(3):741-8. doi: 10.1016/0092-8674(83)90016-8.
Radany et al., Increased spontaneous mutation frequency in human cells expressing the phage PBS2-encoded inhibitor of uracil-DNA glycosylase. Mutat Res. Sep. 15, 2000;461(1):41-58. doi: 10.1016/s0921-8777(00)00040-9.
Raina et al., PROTAC-induced BET protein degradation as a therapy for castration-resistant prostate cancer. Proc Natl Acad Sci U S A. Jun. 28, 2016;113(26):7124-9. doi: 10.1073/pnas.1521738113. Epub Jun. 6, 2016.
Rakonjac et al., Roles of PIII in filamentous phage assembly. J Mol Biol. 1998; 282(1)25-41.
Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.
Ramamurthy et al., Identification of immunogenic B-cell epitope peptides of rubella virus E1 glycoprotein towards development of highly specific immunoassays and/or vaccine. Conference Abstract. 2019.
Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.
Ramirez et al., Unexpected failure rates for modular assembly of engineered zinc fingers. Nat Methods. May 2008;5(5):374-5. Doi: 10.1038/nmeth0508-374.
Ran et al., Double Nicking by RNA-guided CRISPR Cas9 for Enhanced Genome Editing Specificity. Cell. Sep. 12, 2013;154(6):1380-9. doi: 10.1016/j.cell.2013.08.021. Epub Aug. 29, 2013.
Ran et al., Genome engineering using the CRISPR-Cas9 system. Nat Protoc. Nov. 2013;8(11):2281-308.doi: 10.1038/nprot.2013.143. Epub Oct. 24, 2013.
Ran et al., In vivo genome editing using *Staphylococcus aureus* Cas9. Nature. Apr. 9, 2015;520(7546):186-91. doi: 10.1038/nature14299. Epub Apr. 1, 2015.
Ranzau et al., Genome, Epigenome, and Transcriptome Editing via Chemical Modification of Nucleobases in Living Cells. Biochemistry. Feb. 5, 2019;58(5):330-335. doi: 10.1021/acs.biochem.8b00958. Epub Dec. 12, 2018.

(56) References Cited

OTHER PUBLICATIONS

Rashel et al., A novel site-specific recombination system derived from bacteriophage phiMR11. Biochem Biophys Res Commun. Apr. 4, 2008;368(2):192-8. doi: 10.1016/j.bbrc.2008.01.045. Epub Jan. 22, 2008.

Rasila et al., Critical evaluation of random mutagenesis by error-prone polymerase chain reaction protocols, *Escherichia coli* mutator strain, and hydroxylamine treatment. Anal Biochem. May 1, 2009;388(1):71-80. doi: 10.1016/j.ab.2009.02.008. Epub Feb. 10, 2009.

Raskin et al., Substitution of a single bacteriophage T3 residue in bacteriophage T7 RNA polymerase at position 748 results in a switch in promoter specificity. J Mol Biol. Nov. 20, 1992;228(2):506-15.

Raskin et al., T7 RNA polymerase mutants with altered promoter specificities. Proc Natl Acad Sci U S A. Apr. 15, 1993;90(8):3147-51.

Rath et al., Fidelity of end joining in mammalian episomes and the impact of Metnase on joint processing. BMC Mol Biol. Mar. 22, 2014;15:6. doi: 10.1186/1471-2199-15-6.

Rauch et al., Programmable RNA Binding Proteins for Imaging and Therapeutics. Biochemistry. Jan. 30, 2018;57(4):363-364. doi: 10.1021/acs.biochem.7b01101. Epub Nov. 17, 2017.

Ravishankar et al., X-ray analysis of a complex of *Escherichia coli* uracil DNA glycosylase (EcUDG) with a proteinaceous inhibitor. The structure elucidation of a prokaryotic UDG. Nuclei Acids Res. 26 (21): 4880-4887 (1998).

Ray et al., A compendium of RNA-binding motifs for decoding gene regulation. Nature. Jul. 11, 2013;499(7457): 172-7. doi: 10.1038/nature12311.

Ray et al., Homologous recombination: ends as the means. Trends Plant Sci. Oct. 2002;7(10):435-40.

Rebar et al., Phage display methods for selecting zinc finger proteins with novel DNA-binding specificities. Methods Enzymol. 1996;267:129-49.

Rebuzzini et al., New mammalian cellular systems to study mutations introduced at the break site by non-homologous end-joining. DNA Repair (Amst). May 2, 2005;4(5):546-55.

Rees et al., Analysis and minimization of cellular RNA editing by DNA adenine base editors. Sci Adv. May 8, 2019;5(5):eaax5717. doi: 10.1126/sciadv.aax5717.

Rees et al., Base editing: precision chemistry on the genome and transcriptome of living cells. Nat Rev Genet. Dec. 2018;19(12):770-788. doi: 10.1038/s41576-018-0059-1.

Rees et al., Development of hRad51-Cas9 nickase fusions that mediate HDR without double-stranded breaks. Nat Commun. May 17, 2019;10(1):2212. doi: 10.1038/s41467-019-09983-4.

Rees et al., Improving the DNA specificity and applicability of base editing through protein engineering and protein delivery. Nat Commun. Jun. 6, 2017;8:15790. doi: 10.1038/ncomms15790.

Relph et al., Recent developments and current status of gene therapy using viral vectors in the United Kingdom. BMJ. 2004;329(7470):839-842. doi:10.1136/bmj.329.7470.839.

Remy et al., Gene transfer with a series of lipophilic DNA-binding molecules. Bioconjug Chem. Nov.-Dec. 1994;5(6):647-54. doi: 10.1021/bc00030a021.

Ren et al., In-line Alignment and $Mg^2$? Coordination at the Cleavage Site of the env22 Twister Ribozyme. Nat Commun. Nov. 20, 2014;5:5534. doi: 10.1038/ncomms6534.

Ren et al., Pistol Ribozyme Adopts a Pseudoknot Fold Facilitating Site-Specific In-Line Cleavage. Nat Chem Biol. Sep. 2016;12(9):702-8. doi: 10.1038/nchembio.2125. Epub Jul. 11, 2016.

Reyon et al., FLASH assembly of TALENs for high-throughput genome editing. Nat Biotechnol. May 2012;30(5):460-5. doi: 10.1038/nbt.2170.

Ribeiro et al., Protein Engineering Strategies to Expand CRISPR-Cas9 Applications. Int J Genomics. Aug. 2, 2018;2018:1652567. doi: 10.1155/2018/1652567.

Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.

Richter et al., Function and regulation of clustered regularly interspaced short palindromic repeats (CRISPR) / CRISPR associated (Cas) systems. Viruses. Oct. 19, 2012;4(10):2291-311. doi: 10.3390/v4102291.

Richter et al.,. Phage-assisted evolution of an adenine base editor with improved Cas domain compatibility and activity. Nat Biotechnol. Jul. 2020;38(7):883-891. doi: 10.1038/s41587-020-0453-z. Epub Mar. 16, 2020.

Riechmann et al.,. The C-terminal domain of TolA is the coreceptor for filamentous phage infection of *E. coli*. Cell. 1997; 90(2):351-60. PMID:9244308.

Ringrose et al., The Kw recombinase, an integrase from Kluyveromyces waltii. Eur J Biochem. Sep. 15, 1997;248(3):903-12. doi: 10.1111/j.1432-1033.1997.00903.x.

Risso et al., Hyperstability and substrate promiscuity in laboratory resurrections of Precambrian ?-lactamases. J Am Chem Soc. Feb. 27, 2013;135(8):2899-902. doi: 10.1021/ja311630a. Epub Feb. 14, 2013.

Ritchie et al., limma powers differential expression analyses for RNA-sequencing and microarray studies. Nucleic Acids Res. Apr. 20, 2015;43(7):e47. doi: 10.1093/nar/gkv007. Epub Jan. 20, 2015.

Robertson et al.,DNA repair in mammalian cells: Base excision repair: the long and short of it. Cell Mol Life Sci. Mar. 2009;66(6):981-93. doi: 10.1007/s00018-009-8736-z.

Robinson et al., The protein tyrosine kinase family of the human genome. Oncogene. Nov. 20, 2000;19(49):5548-57. doi: 10.1038/sj.onc.1203957.

Rogozin et al., Evolution and diversification of lamprey antigen receptors: evidence for involvement of an AID-APOBEC family cytosine deaminase. Nat Immunol. Jun. 2007;8(6):647-56. doi: 10.1038/ni1463. Epub Apr. 29, 2007.

Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.

Roth et al., A widespread self-cleaving ribozyme class is revealed by bioinformatics. Nat Chem Biol. Jan. 2014;10(1):56-60. doi: 10.1038/nchembio.1386. Epub Nov. 17, 2013.

Roth et al., Purification and characterization of murine retroviral reverse transcriptase expressed in *Escherichia coli*. J Biol Chem. Aug. 5, 1985;260(16):9326-35.

Rouet et al., Expression of a site-specific endonuclease stimulates homologous recombination in mammalian cells. Proc Natl Acad Sci U S A. Jun. 21, 1994;91(13):6064-8. doi: 10.1073/pnas.91.13.6064.

Rouet et al., Introduction of double-strand breaks into the genome of mouse cells by expression of a rare-cutting endonuclease. Mol Cell Biol. Dec. 1994;14(12):8096-106. doi: 10.1128/mcb.14.12.8096.

Rouet et al., Receptor-Mediated Delivery of CRISPR-Cas9 Endonuclease for Cell-Type-Specific Gene Editing. J Am Chem Soc. May 30, 2018;140(21):6596-6603. doi: 10.1021/jacs.8b01551. Epub May 18, 2018.

Roundtree et al.,YTHDC1 mediates nuclear export of N6-methyladenosine methylated mRNAs. Elife. Oct. 6, 2017;6:e31311. doi: 10.7554/eLife.31311.

Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.

Rowland et al., Sin recombinase from *Staphylococcus aureus*: synaptic complex architecture and transposon targeting. Mol Microbiol. May 2002;44(3):607-19. doi: 10.1046/j.1365-2958.2002.02897.x.

Rowley, Chromosome translocations: dangerous liaisons revisited. Nat Rev Cancer. Dec. 2001;1(3):245-50. doi: 10.1038/35106108.

Rubio et al., An adenosine-to-inosine tRNA-editing enzyme that can perform C-to-U deamination of DNA. Proc Natl Acad Sci U S A. May 8, 2007;104(19):7821-6. doi: 10.1073/pnas.0702394104. Epub May 1, 2007. PMID: 17483465; PMCID: PMC1876531.

(56) References Cited

OTHER PUBLICATIONS

Rubio et al., Transfer RNA travels from the cytoplasm to organelles. Wiley Interdiscip Rev RNA. Nov.-Dec. 2011;2(6):802-17. doi: 10.1002/wrna.93. Epub Jul. 11, 2011.

Rudolph et al., Synthetic riboswitches for the conditional control of gene expression in Streptomyces coelicolor. Microbiology. Jul. 2013;159(Pt 7):1416-22. doi: 10.1099/mic.0.067322-0. Epub May 15, 2013.

Rüfer et al., Non-contact positions impose site selectivity on Cre recombinase. Nucleic Acids Res. Jul. 1, 2002;30(13):2764-71. doi: 10.1093/nar/gkf399.

Rutherford et al., Attachment site recognition and regulation of directionality by the serine integrases. Nucleic Acids Res. Sep. 2013;41(17):8341-56. doi: 10.1093/nar/gkt580. Epub Jul. 2, 2013.

Ryu et al., Adenine base editing in mouse embryos and an adult mouse model of Duchenne muscular dystrophy. Nat Biotechnol. Jul. 2018;36(6):536-539. doi: 10.1038/nbt.4148. Epub Apr. 27, 2018.

Sadelain et al., Safe harbours for the integration of new DNA in the human genome. Nat Rev Cancer. Dec. 1, 2011;12(1):51-8. doi: 10.1038/nrc3179.

Sadowski, The Flp recombinase of the 2-microns plasmid of *Saccharomyces cerevisiae*. Prog Nucleic Acid Res Mol Biol. 1995;51:53-91.

Sage et al., Proliferation of functional hair cells in vivo in the absence of the retinoblastoma protein. Science. Feb. 18, 2005;307(5712):1114-8. Epub Jan. 13, 2005.

Sakuma et al., MMEJ-assisted gene knock-in using TALENs and CRISPR-Cas9 with the PITCh systems. Nat Protoc. Jan. 2016;11(1):118-33. doi: 10.1038/nprot.2015.140. Epub Dec. 17, 2015.

Sale et al., Y-family DNA polymerases and their role in tolerance of cellular DNA damage. Nat Rev Mol Cell Biol. Feb. 23, 2012;13(3):141-52. doi: 10.1038/nrm3289.

Saleh-Gohari et al., Conservative homologous recombination preferentially repairs DNA double-strand breaks in the S phase of the cell cycle in human cells. Nucleic Acids Res. Jul. 13, 2004;32(12):3683-8. Print 2004.

Samal et al., Cationic polymers and their therapeutic potential. Chem Soc Rev. Nov. 7, 2012;41(21):7147-94. doi: 10.1039/c2cs35094g. Epub Aug. 10, 2012.

Samulski et al., Helper-free stocks of recombinant adeno-associated viruses: normal integration does not require viral gene expression. J Virol. Sep. 1989;63(9):3822-8. doi: 10.1128/JVI.63.9.3822-3828.1989.

Sander et al., CRISPR-Cas systems for editing, regulating and targeting genomes. Nat Biotechnol. Apr. 2014;32(4):347-55. doi: 10.1038/nbt.2842. Epub Mar. 2, 2014.

Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.

Sander et al., Targeted gene disruption in somatic zebrafish cells using engineered TALENs. Nat Biotechnol. Aug. 5, 2011;29(8):697-8. doi: 10.1038/nbt.1934.

Sang et al., A unique uracil-DNA binding protein of the uracil DNA glycosylase superfamily. Nucleic Acids Res. Sep. 30, 2015;43(17):8452-63. doi: 10.1093/nar/gkv854. Epub Aug. 24, 2015.

Sang, Prospects for transgenesis in the chick. Meeh Dev. Sep. 2004;121(9):1179-86.

Sanjana et al., A transcription activator-like effector toolbox for genome engineering. Nat Protoc. Jan. 5, 2012;7(1):171-92. doi: 10.1038/nprot.2011.431.

Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.

Santoro et al., Directed evolution of the site specificity of Cre recombinase. Proc Natl Acad Sci U S A. Apr. 2, 2002;99(7):4185-90. Epub Mar. 19, 2002.

Saparbaev et al., Excision of hypoxanthine from DNA containing dIMP residues by the *Escherichia coli*, yeast, rat, and human alkylpurine DNA glycosylases. Proc Natl Acad Sci U S A. Jun. 21, 1994;91(13):5873-7. doi: 10.1073/pnas.91.13.5873.

Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.

Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.

Sarkar et al., HIV-1 pro viral DNA excision using an evolved recombinase. Science. Jun. 29, 2007;316(5833):1912-5. doi: 10.1126/science.1141453.

Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.

Sasidharan et al., The selection of acceptable protein mutations. PNAS; Jun. 12, 2007;104(24):10080-5. www.pnas.org/cgi/doi/10.1073.pnas.0703737104.

Satomura et al., Precise genome-wide base editing by the CRISPR Nickase system in yeast. Sci Rep. May 18, 2017;7(1):2095. doi: 10.1038/s41598-017-02013-7.

Saudek et al., A preliminary trial of the programmable implantable medication system for insulin delivery. N Engl J Med. Aug. 31, 1989;321(9):574-9.

Sauer et al., DNA recombination with a heterospecific Cre homolog identified from comparison of the pac-c1 regions of P1-related phages. Nucleic Acids Res. Nov. 18, 2004;32(20):6086-95. doi: 10.1093/nar/gkh941.

Savic et al., Covalent linkage of the DNA repair template to the CRISPR-Cas9 nuclease enhances homology-directed repair. Elife. May 29, 2018;7:e33761. doi: 10.7554/eLife.33761.

Saville et al., A site-specific self-cleavage reaction performed by a novel RNA in Neurospora mitochondria. Cell. May 18, 1990;61(4):685-96. doi: 10.1016/0092-8674(90)90480-3.

Savva et al., The structural basis of specific base-excision repair by uracil-DNA glycosylase. Nature. Feb. 9, 1995;373(6514):487-93. doi: 10.1038/373487a0.

Schaaper et al., Base selection, proofreading, and mismatch repair during DNA replication in *Escherichia coli*. J Biol Chem. Nov. 15, 1993;268(32):23762-5.

Schaaper et al., Spectra of spontaneous mutations in *Escherichia coli* strains defective in mismatch correction: the nature of in vivo DNA replication errors. Proc Natl Acad Sci U S A. Sep. 1987;84(17):6220-4.

Schaefer et al., Understanding RNA modifications: the promises and technological bottlenecks of the 'epitranscriptome'. Open Biol. May 2017;7(5):170077. doi: 10.1098/rsob.170077.

Schechner et al., Multiplexable, locus-specific targeting of long RNAs with CRISPR-Display. Nat Methods. Jul. 2015;12(7):664-70. doi: 10.1038/nmeth.3433. Epub Jun. 1, 2015. Author manuscript entitled CRISPR Display: A modular method for locus-specific targeting of long noncoding RNAs and synthetic RNA devices in vivo.

Schek et al., Definition of the upstream efficiency element of the simian virus 40 late polyadenylation signal by using in vitro analyses. Mol Cell Biol. Dec. 1992;12(12):5386-93. doi: 10.1128/mcb.12.12.5386.

Schenk et al., MPDU1 mutations underlie a novel human congenital disorder of glycosylation, designated type If. J Clin Invest. Dec. 2001;108(11):1687-95. doi: 10.1172/JCI13419.

Schmitz et al., Behavioral abnormalities in prion protein knockout mice and the potential relevance of PrP(C) for the cytoskeleton. Prion. 2014;8(6):381-6. doi: 10.4161/19336896.2014.983746.

Schöller et al., Interactions, localization, and phosphorylation of the m6A generating METTL3-METTL14-WTAP complex. RNA. Apr. 2018;24(4):499-512. doi: 10.1261/ma.064063.117. Epub Jan. 18, 2018.

Schrtefer et al., Low pressure DNA shearing: a method for random DNA sequence analysis. Nucleic Acids Res. Dec. 25, 1990;18(24):7455-6.

(56) References Cited

OTHER PUBLICATIONS

Schultz et al., Expression and secretion in yeast of a 400-kDa envelope glycoprotein derived from Epstein-Barr virus. Gene. 1987;54(1):113-23. doi: 10.1016/0378-1119(87)90353-2.
Schultz et al., 01igo-2'-fluoro-2'-deoxynucleotide N3'→P5' phosphoramidates: synthesis and properties. Nucleic Acids Res. Aug. 1, 1996;24(15):2966-73.
Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.
Schwartz et al., Post-translational enzyme activation in an animal via optimized conditional protein splicing. Nat Chem Biol. Jan. 2007;3(1):50-4. Epub Nov. 26, 2006.
Schwarze et al., In vivo protein transduction: delivery of a biologically active protein into the mouse. Science. Sep. 3, 1999;285(5433):1569-72.
Sclimenti et al., Directed evolution of a recombinase for improved genomic integration at a native human sequence. Nucleic Acids Res. Dec. 15, 2001;29(24):5044-51.
Scott et al., Production of cyclic peptides and proteins in vivo. Proc Natl Acad Sci U S A. Nov. 23, 1999;96(24):13638-43. doi: 10.1073/pnas.96.24.13638.
Sebastían-Martín et al., Transcriptional inaccuracy threshold attenuates differences in RNA-dependent DNA synthesis fidelity between retroviral reverse transcriptases. Sci Rep. Jan. 12, 2018;8(1):627. doi: 10.1038/s41598-017-18974-8.
Seed, An LFA-3 cDNA encodes a phospholipid-linked membrane protein homologous to its receptor CD2. Nature. Oct. 29-Nov. 4, 1987;329(6142):840-2. doi: 10.1038/329840a0.
Sefton et al., Implantable pumps. Crit Rev Biomed Eng. 1987;14(3):201-40.
Segal et al., Toward controlling gene expression at will: selection and design of zinc finger domains recognizing each of the 5'-GNN-3' Dna target sequences. Proc Natl Acad Sci U S A. Mar. 16, 1999;96(6):2758-63.
Sells et al., Delivery of protein into cells using polycationic liposomes. Biotechniques. Jul. 1995;19(1):72-6, 78.
Semenova et al., Interference by clustered regularly interspaced short palindromic repeat (Crispr) RNA is governed by a seed sequence. Proc Natl Acad Sci U S A. Jun. 21, 2011;108(25):10098-103. doi: 10.1073/pnas.1104144108. Epub Jun. 6, 2011.
Semple et al., Rational design of cationic lipids for siRNA delivery. Nat Biotechnol. Feb. 2010;28(2):172-6. doi: 10.1038/nbt.1602. Epub Jan. 17, 2010.
Serganov et al., Coenzyme recognition and gene regulation by a flavin mononucleotide riboswitch. Nature. Mar. 12, 2009;458(7235):233-7. doi: 10.1038/nature07642. Epub Jan. 25, 2009.
Serganov et al., Structural basis for discriminative regulation of gene expression by adenine- and guanine-sensing mRNAs. Chem Biol. Dec. 2004;11(12):1729-41.
Serganov et al., Structural basis for gene regulation by a thiamine pyrophosphate-sensing riboswitch. Nature. Jun. 29, 2006;441(7097):1167-71. Epub May 21, 2006.
Seripa et al., The missing ApoE allele. Ann Hum Genet. Jul. 2007;71(Pt 4):496-500. Epub Jan. 22, 2007.
Serrano-Heras et al., Protein p56 from the Bacillus subtilis phage phi29 inhibits DNA-binding ability of uracil-DNA glycosylase. Nucleic Acids Res. 2007;35(16):5393-401. Epub Aug. 13, 2007.
Setten et al., The current state and future directions of RNAi-based therapeutics. Nat Rev Drug Discov. Jun. 2019;18(6):421-446. doi: 10.1038/s41573-019-0017-4.
Severinov et al., Expressed protein ligation, a novel method for studying protein-protein interactions in transcription. J Biol Chem. Jun. 26, 1998;273(26):16205-9. doi: 10.1074/jbc.273.26.16205.
Sha et al., Monobodies and other synthetic binding proteins for expanding protein science. Protein Sci. May 2017;26(5):910-924. doi: 10.1002/pro.3148. Epub Mar. 24, 2017.
Shah et al., Inteins: nature's gift to protein chemists. Chem Sci. 2014;5(1):446-461.
Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.
Shah et al., Protospacer recognition motifs: mixed identities and functional diversity. RNA Biol. May 2013;10(5):891-9. doi: 10.4161/rna.23764. Epub Feb. 12, 2013.
Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.
Shalem et al., High-throughput functional genomics using CRISPR-Cas9. Nat Rev Genet. May 2015;16(5):299-311. doi: 10.1038/nrg3899. Epub Apr. 9, 2015.
Shalem et al., Genome-scale CRISPR-Cas9 knockout screening in human cells. Science. Jan. 3, 2014;343(6166):84-7. doi: 10.1126/science.1247005. Epub Dec. 12, 2013.
Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.
Sharer et al., The ARF-like 2 (ARL2)-binding protein, BART. Purification, cloning, and initial characterization. J Biol Chem. Sep. 24, 1999;274(39):27553-61. doi: 10.1074/jbc.274.39.27553.
Sharma et al., Efficient introduction of aryl bromide functionality into proteins in vivo. FEBS Lett. Feb. 4, 2000;467(1):37-40.
Sharon et al., Functional Genetic Variants Revealed by Massively Parallel Precise Genome Editing. Cell. Oct. 4, 2018;175(2):544-557.e16. doi: 10.1016/j.cell.2018.08.057. Epub Sep. 20, 2018.
Shaw et al., Implications of human genome architecture for rearrangement-based disorders: the genomic basis of disease. Hum Mol Genet. Apr. 1, 2004;13 Spec No. 1:R57-64. doi: 10.1093/hmg/ddh073. Epub Feb. 5, 2004.
Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.
Shee et al., Engineered proteins detect spontaneous DNA breakage in human and bacterial cells. Elife. Oct. 29, 2013;2:e01222. doi: 10.7554/eLife.01222.
Shen et al., Predictable and precise template-free CRISPR editing of pathogenic variants. Nature. Nov. 2018;563(7733):646-651. doi: 10.1038/s41586-018-0686-x. Epub Nov. 7, 2018.
Shen, Data processing, Modeling and Analysis scripts for CRISPR-inDelphi. GitHub—maxwshen/indelphi-dataprocessinganalysis at 6b68e3cec73c9358fef6e5f178a935f3c2a4118f. Apr. 10, 2018. Retrieved online via https://github.com/maxwshen/indelphi-sataprocessinganalysis/tree/6b68e3cec73c9358fef6e5f178a935f3c2a4118f Last retrieved on Jul. 26, 2021. 2 pages.
Sheridan, First CRISPR-Cas patent opens race to stake out intellectual property. Nat Biotechnol. 2014;32(7):599-601.
Sheridan, Gene therapy finds its niche. Nat Biotechnol. Feb. 2011;29(2):121-8. doi: 10.1038/nbt.1769.
Sherwood et al., Discovery of directional and nondirectional pioneer transcription factors by modeling DNase profile magnitude and shape. Nat Biotechnol. Feb. 2014;32(2):171-178. doi: 10.1038/nbt.2798. Epub Jan. 19, 2014.
Shi et al., Structural basis for targeted DNA cytosine deamination and mutagenesis by APOBEC3A and APOBEC3B. Nat Struct Mol Biol. Feb. 2017;24(2):131-139. doi: 10.1038/nsmb.3344. Epub Dec. 19, 2016.
Shi et al., YTHDF3 facilitates translation and decay of N6-methyladenosine-modified RNA. Cell Res. Mar. 2017;27(3):315-328. doi: 10.1038/cr.2017.15. Epub Jan. 20, 2017.
Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.
Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.
Shin et al., CRISPR/Cas9 targeting events cause complex deletions and insertions at 17 sites in the mouse genome. Nat Commun. May 31, 2017;8:15464. doi: 10.1038/ncomms15464.

(56) References Cited

OTHER PUBLICATIONS

Shindo et al., A Comparison of Two Single-Stranded DNA Binding Models by Mutational Analysis of APOBEC3G. Biology (Basel). Aug. 2, 2012;1(2):260-76. doi: 10.3390/biology1020260.

Shingledecker et al., Molecular dissection of the *Mycobacterium tuberculosis* RecA intein: design of a minimal intein and of a trans-splicing system involving two intein fragments. Gene. Jan. 30, 1998;207(2):187-95. doi: 10.1016/s0378-1119(97)00624-0.

Shmakov et al., Discovery and Functional Characterization of Diverse Class 2 CRISPR Cas Systems. Molecular Cell Nov. 2015;60(3):385-97.

Shmakov et al., Diversity and evolution of class 2 CRISPR-Cas systems. Nat Rev Microbiol. Mar. 2017;15(3):169-182. doi: 10.1038/nrmicro.2016.184. Epub Jan. 23, 2017.

Shultz et al., A genome-wide analysis of FRT-like sequences in the human genome. PLoS One. Maar. 23, 2011;6(3):e18077. doi: 10.1371/journal.pone.0018077.

Siebert et al., An improved PCR method for walking in uncloned genomic DNA. Nucleic Acids Res. Mar. 25, 1995;23(6):1087-8.

Silas et al., Direct CRISPR spacer acquisition from RNA by a natural reverse transcriptase-Cas1 fusion protein. Science. Feb. 26, 2016;351(6276):aad4234. doi: 10.1126/science.aad4234.

Silva et al., Selective disruption of the DNA polymerase III α-β complex by the umuD gene products. Nucleic Acids Res. Jul. 2012;40(12):5511-22. doi: 10.1093/nar/gks229. Epub Mar. 9, 2012.

Simonelli et al., Base excision repair intermediates are mutagenic in mammalian cells. Nucleic Acids Res. Aug. 2, 2005;33(14):4404-11. Print 2005.

Singh et al., Cross-talk between diverse serine integrases. J Mol Biol. Jan. 23, 2014;426(2):318-31. doi: 10.1016/j.jmb.2013.10.013. Epub Oct. 22, 2013.

Singh et al., Real-time observation of DNA recognition and rejection by the RNA-guided endonuclease Cas9. Nat Commun. Sep. 14, 2016;7:12778. doi: 10.1038/ncomms12778.

Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.

Sivalingam et al., Biosafety assessment of site-directed transgene integration in human umbilical cord-lining cells. Mol Ther. Jul. 2010;18(7):1346-56. doi: 10.1038/mt.2010.61. Epub Apr. 27, 2010.

Sjoblom et al., The consensus coding sequences of human breast and colorectal cancers. Science. Oct. 13, 2006;314(5797):268-74. Epub Sep. 7, 2006.

Skretas et al., Regulation of protein activity with small-molecule-controlled inteins. Protein Sci. Feb. 2005;14(2):523-32. Epub Jan. 4, 2005.

Slaymaker et al., Rationally engineered Cas9 nucleases with improved specificity. Science. Jan. 1, 2016;351(6268):84-8. doi: 10.1126/science.aad5227. Epub Dec. 1, 2015.

Sledz et al., Structural insights into the molecular mechanism of the m(6)A writer complex. Elife. Sep. 14, 2016;5:e18434. doi: 10.7554/eLife.18434.

Slupphaug et al., A nucleotide-flipping mechanism from the structure of human uracil-DNA glycosylase bound to DNA. Nature. Nov. 7, 1996;384(6604):87-92. doi: 10.1038/384087a0.

Smargon et al., Cas13b Is a Type VI-B CRISPR-Associated RNA-Guided RNase Differentially Regulated by Accessory Proteins Csx27 and Csx28. Mol Cell. Feb. 16, 2017;65(4):618-630.e7. doi: 10.1016/j.molcel.2016.12.023. Epub Jan. 5, 2017.

Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.

Smith et al., Production of human beta interferon in insect cells infected with a baculovirus expression vector. Mol Cell Biol. Dec. 1983;3(12):2156-65. doi: 10.1128/mcb.3.12.2156.

Smith et al., Single-step purification of polypeptides expressed in *Escherichia coli* as fusions with glutathione S-transferase. Gene. Jul. 15, 1988;67(1):31-40. doi: 10.1016/0378-1119(88)90005-4.

Smith, Filamentous fusion phage: novel expression vectors that display cloned antigens on the virion surface. Science. Jun. 14, 1985;228(4705):1315-7.

Smith, Phage-encoded Serine Integrases and Other Large Serine Recombinases. Microbiol Spectr. Aug. 2015;3(4). doi: 10.1128/microbiolspec.MDNA3-0059-2014.

Sommerfelt et al., Receptor interference groups of 20 retroviruses plating on human cells. Virology. May 1990;176(1):58-69. doi: 10.1016/0042-6822(90)90230-o.

Song et al., Adenine base editing in an adult mouse model of tyrosinaemia. Nat Biomed Eng. Jan. 2020;4(1):125-130. doi: 10.1038/s41551-019-0357-8. Epub Feb. 25, 2019.

Southworth et al., Control of protein splicing by intein fragment reassembly. EMBO J. Feb. 16, 1998;17(4):918-26. doi: 10.1093/emboj/17.4.918.

Southworth et al., Purification of proteins fused to either the amino or carboxy terminus of the *Mycobacterium xenopi* gyrase A intein. Biotechniques. Jul. 1999;27(1):110-4, 116, 118-20. doi: 10.2144/99271st04.

Spencer et al., A general strategy for producing conditional alleles of Src-like tyrosine kinases. Proc Natl Acad Sci U S A. Oct. 10, 1995;92(21):9805-9. doi: 10.1073/pnas.92.21.9805.

Spencer et al., Controlling signal transduction with synthetic ligands. Science. Nov. 12, 1993;262(5136):1019-24. doi: 10.1126/science.7694365.

Spencer et al., Functional analysis of Fas signaling in vivo using synthetic inducers of dimerization. Curr Biol. Jul. 1, 1996;6(7):839-47. doi: 10.1016/s0960-9822(02)00607-3.

Srivastava et al., An inhibitor of nonhomologous end-joining abrogates double-strand break repair and impedes cancer progression. Cell. Dec. 21, 2012;151(7):1474-87. doi: 10.1016/j.cell.2012.11.054.

Stadtman, Selenocysteine. Annu Rev Biochem. 1996;65:83-100.

Stamos et al., Structure of a Thermostable Group II Intron Reverse Transcriptase with Template-Primer and Its Functional and Evolutionary Implications. Mol Cell. Dec. 7, 2017;68(5):926-939.e4. doi: 10.1016/j.molcel.2017.10.024. Epub Nov. 16, 2017.

Steele et al., The prion protein knockout mouse: a phenotype under challenge. Prion. Apr.-Jun. 2007;1(2):83-93. doi: 10.4161/pri.1.2.4346. Epub Apr. 25, 2007.

Stella et al., Structure of the Cpf1 endonuclease R-loop complex after target DNA cleavage. Nature. Jun. 22, 2017;546(7659):559-563. doi: 10.1038/nature22398. Epub May 31, 2017.

Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.

Stenson et al., The Human Gene Mutation Database: towards a comprehensive repository of inherited mutation data for medical research, genetic diagnosis and next-generation sequencing studies. Hum Genet. Jun. 2017;136(6):665-677. doi: 10.1007/s00439-017-1779-6. Epub Mar. 27, 2017.

Stephens et al., The landscape of cancer genes and mutational processes in breast cancer. Nature Jun. 2012;486:400-404. doi: 10.1038/nature11017.

Sternberg et al., Conformational control of DNA target cleavage by CRISPR-Cas9. Nature. Nov. 5, 2015;527(7576):110-3. doi: 10.1038/nature15544. Epub Oct. 28, 2015.

Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.

Sterne-Weiler et al., Exon identity crisis: disease-causing mutations that disrupt the splicing code. Genome Biol. Jan. 23, 2014;15(1):201. doi: 10.1186/gb4150.

Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.

Stevens et al., A promiscuous split intein with expanded protein engineering applications. Proc Natl Acad Sci U S A. Aug. 8, 2017;114(32):8538-8543. doi: 10.1073/pnas.1701083114. Epub Jul. 24, 2017.

(56) References Cited

OTHER PUBLICATIONS

Stockwell et al., Probing the role of homomeric and heteromeric receptor interactions in TGF-beta signaling using small molecule dimerizers. Curr Biol. Jun. 18, 1998;8(13):761-70. doi: 10.1016/s0960-9822(98)70299-4.
Strecker et al., RNA-guided DNA insertion with CRISPR-associated transposases. Science. Jul. 5, 2019;365(6448):48-53. doi: 10.1126/science.aax9181. Epub Jun. 6, 2019.
Strutt et al., RNA-dependent RNA targeting by CRISPR-Cas9. Elife. Jan. 5, 2018;7:e32724. doi: 10.7554/eLife.32724.
Su et al., Human DNA polymerase ? has reverse transcriptase activity in cellular environments. J Biol Chem. Apr. 12, 2019;294(15):6073-6081. doi: 10.1074/jbc.RA119.007925. Epub Mar. 6, 2019.
Sudarsan et al., An mRNA structure in bacteria that controls gene expression by binding lysine. Genes Dev. Nov. 1, 2003;17(21):2688-97.
Suess et al., A theophylline responsive riboswitch based on helix slipping controls gene expression in vivo. Nucleic Acids Res. Mar. 5, 2004;32(4): 1610-4.
Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.
Sun et al., The CRISPR/Cas9 system for gene editing and its potential application in pain research. Transl Periop & Pain Med. Aug. 3, 2016;1(3):22-33.
Surun et al., High Efficiency Gene Correction in Hematopoietic Cells by Donor-Template-Free CRISPR/Cas9 Genome Editing. Mol Ther Nucleic Acids. Mar. 2, 2018;10:1-8. doi: 10.1016/j.omtn.2017.11.001. Epub Nov. 10, 2017.
Suzuki et al., In vivo genome editing via CRISPR/Cas9 mediated homology-independent targeted integration. Nature. Dec. 1, 2016;540(7631):144-149. doi: 10.1038/nature20565. Epub Nov. 16, 2016.
Suzuki et al., VCre/VloxP and SCre/SloxP: new site-specific recombination systems for genome engineering. Nucleic Acids Res. Apr. 2011;39(8):e49. doi: 10.1093/nar/gkq1280. Epub Feb. 1, 2011.
Swarts et al., Argonaute of the archaeon *Pyrococcus furiosus* is a DNA-guided nuclease that targets cognate DNA. Nucleic Acids Res. May 26, 2015;43(10):5120-9. doi: 10.1093/nar/gkv415. Epub Apr. 29, 2015.
Swarts et al., DNA-guided DNA interference by a prokaryotic Argonaute. Nature. Mar. 13, 2014;507(7491):258-61. doi: 10.1038/nature12971. Epub Feb. 16, 2014.
Swarts et al., The evolutionary journey of Argonaute proteins. Nat Struct Mol Biol. Sep. 2014;21(9):743-53. doi: 10.1038/nsmb.2879.
Szczepek et al., Structure-based redesign of the dimerization interface reduces the toxicity of zinc-finger nucleases. Nat Biotechnol. Jul. 2007;25(7):786-93. Epub Jul. 1, 2007.
Tabebordbar et al., In vivo gene editing in dystrophic mouse muscle and muscle stem cells. Science. Jan. 22, 2016;351(6271):407-411. doi: 10.1126/science.aad5177. Epub Dec. 31, 2015.
Tagalakis et al., Lack of RNA-DNA oligonucleotide (chimeraplast) mutagenic activity in mouse embryos. Mol Reprod Dev. Jun. 2005;71(2):140-4.
Tahara et al., Potent and Selective Inhibitors of 8-Oxoguanine DNA Glycosylase. J Am Chem Soc. Feb. 14, 2018;140(6):2105-2114. doi: 10.1021/jacs.7b09316. Epub Feb. 5, 2018.
Tajiri et al., Functional cooperation of MutT, MutM and MutY proteins in preventing mutations caused by spontaneous oxidation of guanine nucleotide in *Escherichia coli*. Mutat Res. May 1995;336(3):257-67. doi: 10.1016/0921-8777(94)00062-b.
Takimoto et al., Stereochemical basis for engineered pyrrolysyl-tRNA synthetase and the efficient in vivo incorporation of structurally divergent non-native amino acids. ACS Chem Biol. Jul. 15, 2011;6(7):733-43. doi: 10.1021/cb200057a. Epub May 5, 2011.
Tambunan et al., Vaccine Design for H5N1 Based on B- and T-cell Epitope Predictions. Bioinform Biol Insights. Apr. 28, 2016;10:27-35. doi: 10.4137/BBI.S38378.
Tanenbaum et al., A protein-tagging system for signal amplification in gene expression and fluorescence imaging. Cell. Oct. 23, 2014;159(3):635-46. doi: 10.1016/j.cell.2014.09.039. Epub Oct. 9, 2014.
Tanese et al., Expression of enzymatically active reverse transcriptase in *Escherichia coli*. Proc Natl Acad Sci U S A. Aug. 1985;82(15):4944-8. doi: 10.1073/pnas.82.15.4944.
Tang et al., Aptazyme-embedded guide RNAs enable ligand-responsive genome editing and transcriptional activation. Nat Commun. Jun. 28, 2017;8:15939. doi: 10.1038/ncomms15939.
Tang et al., Evaluation of Bioinformatic Programmes for the Analysis of Variants within Splice Site Consensus Regions. Adv Bioinformatics. 2016;2016:5614058. doi: 10.1155/2016/5614058. Epub May 24, 2016.
Tang et al., Rewritable multi-event analog recording in bacterial and mammalian cells. Science. Apr. 13, 2018;360(6385):eaap8992. doi: 10.1126/science.aap8992. Epub Feb. 15, 2018.
Tassabehji, Williams-Beuren syndrome: a challenge for genotype-phenotype correlations. Hum Mol Genet. Oct. 15, 2003;12 Spec No. 2:R229-37. doi: 10.1093/hmg/ddg299. Epub Sep. 2, 2003.
Taube et al., Reverse transcriptase of mouse mammary tumour virus: expression in bacteria, purification and biochemical characterization. Biochem J. Feb. 1, 1998;329 ( Pt 3)(Pt 3):579-87. doi: 10.1042/bj3290579. Erratum in: Biochem J Jun. 15, 1998;332(Pt 3):808.
Iebas et al., Gene editing of CCR5 in autologous CD4 T cells of persons infected with HIV. N Engl J Med. Mar. 6, 2014;370(10):901-10. doi: 10.1056/NEJMoa1300662.
Tee et al., Polishing the craft of genetic diversity creation in directed evolution. Biotechnol Adv. Dec. 2013;31(8):1707-21. doi: 10.1016/j.biotechadv.2013.08.021. Epub Sep. 6, 2013.
Telenti et al., The *Mycobacterium xenopi* GyrA protein splicing element: characterization of a minimal intein. J Bacteriol. Oct. 1997;179(20):6378-82. doi: 10.1128/jb.179.20.6378-6382.1997.
Telesnitsky et al., RNase H domain mutations affect the interaction between Moloney murine leukemia virus reverse transcriptase and its primer-template. Proc Natl Acad Sci U S A. Feb. 15, 1993;90(4):1276-80. doi: 10.1073/pnas.90.4.1276.
Tessarollo et al., Targeted mutation in the neurotrophin-3 gene results in loss of muscle sensory neurons. Proc Natl Acad Sci U S A. Dec. 6, 1994;91(25):11844-8.
Tesson et al., Knockout rats generated by embryo microinjection of TALENs. Nat Biotechnol. Aug. 5, 2011;29(8):695-6. doi: 10.1038/nbt.1940.
Thompson et al., Cellular uptake mechanisms and endosomal trafficking of supercharged proteins. Chem Biol. Jul. 27, 2012;19(7):831-43. doi: 10.1016/j.chembiol.2012.06.014.
Thompson et al., Engineering and identifying supercharged proteins for macromolecule delivery into mammalian cells. Methods Enzymol. 2012;503:293-319. doi: 10.1016/B978-0-12396962-0.00012-4.
Thomson et al., Mutational analysis of loxP sites for efficient Cre-mediated insertion into genomic DNA. Genesis. Jul. 2003;36(3):162-7. doi: 10.1002/gene.10211.
Thorpe et al., Functional correction of episomal mutations with short DNA fragments and RNA-DNA oligonucleotides. J Gene Med. Mar.-Apr. 2002;4(2):195-204.
Thuronyi et al., Continuous evolution of base editors with expanded target compatibility and improved activity. Nat Biotechnol. Sep. 2019;37(9):1070-1079. doi: 10.1038/s41587-019-0193-0. Epub Jul. 22, 2019.
Thyagarajan et al., Creation of engineered human embryonic stem cell lines using phiC31 integrase. Stem Cells. Jan. 2008;26(1):119-26. doi: 10.1634/stemcells.2007-0283. Epub Oct. 25, 2007.
Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tinland et al., The T-DNA-linked VirD2 protein contains two distinct functional nuclear localization signals. Proc Natl Acad Sci U S A. Aug. 15, 1992;89(16):7442-6. doi: 10.1073/pnas.89.16.7442.
Tirumalai et al., Recognition of core-type DNA sites by lambda integrase. J Mol Biol. Jun. 12, 1998;279(3):513-27.

(56) References Cited

OTHER PUBLICATIONS

Tom et al., Mechanism whereby proliferating cell nuclear antigen stimulates flap endonuclease 1. J Biol Chem. Apr. 7, 2000;275(14):10498-505. doi: 10.1074/jbc.275.14.10498.
Tone et al., Single-stranded DNA binding protein Gp5 of Bacillus subtilis phage ?29 is required for viral DNA replication in growth-temperature dependent fashion. Biosci Biotechnol Biochem. 2012;76(12):2351-3. doi: 10.1271/bbb.120587. Epub Dec. 7, 2012.
Toor et al., Crystal structure of a self-spliced group II intron. Science. Apr. 4, 2008;320(5872):77-82. doi: 10.1126/science.1153803.
Toro et al., On the Origin and Evolutionary Relationships of the Reverse Transcriptases Associated With Type III CRISPR-Cas Systems. Front Microbiol. Jun. 15, 2018;9:1317. doi: 10.3389/fmicb.2018.01317.
Toro et al., The Reverse Transcriptases Associated with CRISPR-Cas Systems. Sci Rep. Aug. 2, 2017;7(1):7089. doi: 10.1038/s41598-017-07828-y.
Torres et al., Non-integrative lentivirus drives high-frequency cre-mediated cassette exchange in human cells. PLoS One. 2011;6(5):e19794. doi: 10.1371/journal.pone.0019794. Epub May 23, 2011.
Tourdot et al., A general strategy to enhance immunogenicity of low-affinity HLA-A2. 1-associated peptides: implication in the identification of cryptic tumor epitopes. Eur J Immunol. Dec. 2000;30(12):3411-21.
Townsend et al., Role of HFE in iron metabolism, hereditary haemochromatosis, anaemia of chronic disease, and secondary iron overload. Lancet. Mar. 2, 2002;359(9308):786-90. doi: 10.1016/S0140-6736(02)07885-6.
Tracewell et al., Directed enzyme evolution: climbing fitness peaks one amino acid at a time. Curr Opin Chem Biol. Feb. 2009;13(1):3-9. doi: 10.1016/j.cbpa.2009.01.017. Epub Feb. 25, 2009.
Tratschin et al., A human parvovirus, adeno-associated virus, as a eucaryotic vector: transient expression and encapsidation of the procaryotic gene for chloramphenicol acetyltransferase. Mol Cell Biol. Oct. 1984;4(10):2072-81. doi: 10.1128/mcb.4.10.2072.
Tratschin et al., Adeno-associated virus vector for high-frequency integration, expression, and rescue of genes in mammalian cells. Mol Cell Biol. Nov. 1985;5(11):3251-60. doi: 10.1128/mcb.5.11.3251.
Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.
Traxler et al., A genome-editing strategy to treat ?-hemoglobinopathies that recapitulates a mutation associated with a benign genetic condition. Nat Med. Sep. 2016;22(9):987-90. doi: 10.1038/nm.4170. Epub Aug. 15, 2016.
Trudeau et al., On the Potential Origins of the High Stability of Reconstructed Ancestral Proteins. Mol Biol Evol. Oct. 2016;33(10):2633-41. doi: 10.1093/molbev/msw138. Epub Jul. 12, 2016.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015. With Supplementary Data.
Tsai et al., CIRCLE-seq: a highly sensitive in vitro screen for genome-wide CRISPR-Cas9 nuclease off-targets. Nat Methods. Jun. 2017;14(6):607-614. doi: 10.1038/nmeth.4278. Epub May 1, 2017.
Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.
Tsai et al., GUIDE-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Tsang et al., Specialization of the DNA-cleaving activity of a group I ribozyme through in vitro evolution. J Mol Biol. Sep. 13, 1996;262(1):31-42. doi: 10.1006/jmbi.1996.0496.
Tsutakawa et al., Human flap endonuclease structures, DNA double-base flipping, and a unified understanding of the FEN1 superfamily. Cell. Apr. 15, 2011;145(2):198-211. doi: 10.1016/j.cell.2011.03.004.
Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.
Turan et al., Recombinase-mediated cassette exchange (RMCE): traditional concepts and current challenges. J Mol Biol. Mar. 25, 2011;407(2):193-221. doi: 10.1016/j.jmb.2011.01.004. Epub Jan. 15, 2011.
Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.
Tycko et al., Pairwise library screen systematically interrogates *Staphylococcus aureus* Cas9 specificity in human cells. bioRxiv. doi: https://doi.org/10.1101/269399 Posted Feb. 22, 2018.
UniProt Consortium, UniProt: the universal protein knowledgebase. Nucleic Acids Research, vol. 45, Issue DI, Jan. 2017, pp. D158-D169, https://doi.org/10.1093/nar/gkw1099.
UniProt Submission; UniProt, Accession No. P01011. Last modified Jun. 11, 2014, version 2. 15 pages.
UniProt Submission; UniProt, Accession No. P01011. Last modified Sep. 18, 2013, version 2. 15 pages.
UniProt Submission; UniProt, Accession No. P04264. Last modified Jun. 11, 2014, version 6. 15 pages.
UniProt Submission; UniProt, Accession No. P04275. Last modified Jul. 9, 2014, version 107. 29 pages.
UniProtein A0A1V6. Dec. 11, 2019.
UniProtKB Submission; Accession No. F0NH53. May 3, 2011. 4 pages.
UniProtKB Submission; Accession No. F0NN87. May 3, 2011. 4 pages.
UniProtKB Submission; Accession No. P0DOC6. No Author Listed., Oct. 5, 2016. 5 pages.
UniProtKB Submission; Accession No. T0D7A2. Oct. 16, 2013. 10 pages.
Urasaki et al., Functional dissection of the Tol2 transposable element identified the minimal cis-sequence and a highly repetitive sequence in the subterminal region essential for transposition. Genetics. Oct. 2006;174(2):639-49. doi: 10.1534/genetics.106.060244. Epub Sep. 7, 2006.
Urnov et al., Genome editing with engineered zinc finger nucleases. Nat Rev Genet. Sep. 2010;11(9):636-46. doi: 10.1038/nrg2842.
Urnov et al., Highly efficient endogenous human gene correction using designed zinc-finger nucleases. Nature. Jun. 2, 2005;435(7042):646-51. Epub Apr. 3, 2005.
Vagner et al., Efficiency of homologous DNA recombination varies along the Bacillus subtilis chromosome. J Bacteriol. Sep. 1988;170(9):3978-82.
Van Brunt et al., Genetically Encoded Azide Containing Amino Acid in Mammalian Cells Enables Site-Specific Antibody-Drug Conjugates Using Click Cycloaddition Chemistry. Bioconjug Chem. Nov. 18, 2015;26(11):2249-60. doi: 10.1021/acs.bioconjchem.5b00359. Epub Sep. 11, 2015.
Van Brunt et al., Molecular Farming: Transgenic Animals as Bioreactors. Biotechnology (NY). 1988;6(10):1149-1154. doi: 10.1038/nbt1088-1149.
Van Duyne et al., Teaching Cre to follow directions. Proc Natl Acad Sci U S A. Jan. 6, 2009;106(1):4-5. doi: 10.1073/pnas.0811624106. Epub Dec. 31, 2008.
Van Overbeek et al., DNA Repair Profiling Reveals Nonrandom Outcomes at Cas9-Mediated Breaks. Mol Cell. Aug. 18, 2016;63(4):633-646. doi: 10.1016/j.molcel.2016.06.037. Epub Aug. 4, 2016.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Van Wijk et al., Identification of 51 novel exons of the Usher syndrome type 2A (USH2A) gene that encode multiple conserved functional domains and that are mutated in patients with Usher

(56) References Cited

OTHER PUBLICATIONS syndrome type II. Am J Hum Genet. Apr. 2004;74(4):738-44. doi: 10.1086/383096. Epub Mar. 10, 2004.
Vanamee et al., FokI requires two specific DNA sites for cleavage. J Mol Biol. May 25, 2001;309(1):69-78.
Varga et al., Progressive vascular smooth muscle cell defects in a mouse model of Hutchinson-Gilford progeria syndrome. Proc Natl Acad Sci U S A. Feb. 28, 2006;103(9):3250-5. doi: 10.1073/pnas.0600012103. Epub Feb. 21, 2006.
Vellore et al., A group II intron-type open reading frame from the thermophile *Bacillus* (*Geobacillus*) *stearothermophilus* encodes a heat-stable reverse transcriptase. Appl Environ Microbiol. Dec. 2004;70(12):7140-7. doi: 10.1128/AEM.70.12.7140-7147.2004.
Verma, The reverse transcriptase. Biochim Biophys Acta. Mar. 21, 1977;473(1):1-38. doi: 10.1016/0304-419x(77)90005-1.
Vigne et al., Third-generation adenovectors for gene therapy. Restor Neurol Neurosci. Jan. 1, 1995;8(1):35-6. doi: 10.3233/RNN-1995-81208.
Vik et al., Endonuclease V cleaves at inosines in RNA. Nat Commun. 2013;4:2271. doi: 10.1038/ncomms3271.
Vilenchik et al., Endogenous DNA double-strand breaks: production, fidelity of repair, and induction of cancer. Proc Natl Acad Sci U S A. Oct. 28, 2003;100(22):12871-6. doi: 10.1073/pnas.2135498100. Epub Oct. 17, 2003.
Vitreschak et al., Regulation of the vitamin B12 metabolism and transport in bacteria by a conserved RNA structural element. RNA. Sep. 2003;9(9):1084-97.
Voigt et al., Rational evolutionary design: the theory of in vitro protein evolution. Adv Protein Chem. 2000;55:79-160.
Vriend et al., Nick-initiated homologous recombination: Protecting the genome, one strand at a time. DNA Repair (Amst). Feb. 2017;50:1-13. doi: 10.1016/j.dnarep.2016.12.005. Epub Dec. 29, 2016.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep. 1, 1998;95(18):10564-9.
Wals et al., Unnatural amino acid incorporation in *E. coli*: current and future applications in the design of therapeutic proteins. Front Chem. Apr. 1, 2014;2:15. doi: 10.3389/fchem.2014.00015. eCollection 2014.
Wang et al. CRISPR-Cas9 and CRISPR-Assisted Cytidine Deaminase Enable Precise and Efficient Genome Editing in Klebsiella pneumoniae. Appl Environ Microbiol. 2018;84(23):e01834-18. Published Nov. 15, 2018. doi:10.1128/AEM.01834-18.
Wang et al., AID upmutants isolated using a high-throughput screen highlight the immunity/cancer balance limiting DNA deaminase activity. Nat Struct Mol Biol. Jul. 2009;16(7):769-76. doi: 10.1038/nsmb. 1623. Epub Jun. 21, 2009.
Wang et al., Continuous directed evolutions of proteins with improved soluble expression. Nature Chemical Biology. Nat Publishing Group. Aug. 20, 2018; 14(10):972-980.
Wang et al., CRISPR-Cas9 Targeting of PCSK9 in Human Hepatocytes In Vivo-Brief Report. Arterioscler Thromb Vasc Biol. May 2016;36(5):783-6. doi: 10.1161/ATVBAHA.116.307227. Epub Mar. 3, 2016.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Enhanced base editing by co-expression of free uracil DNA glycosylase inhibitor. Cell Res. Oct. 2017;27(1):1289-92. doi: 10.1038/cr.2017.111. Epub Aug. 29, 2017.
Wang et al., Evolution of new nonantibody proteins via iterative somatic hypermutation. Proc Natl Acad Sci U S A. Nov. 30, 2004;101(48):16745-9. Epub Nov. 19, 2004.
Wang et al., Expanding the genetic code. Annu Rev Biophys Biomol Struct. 2006;35:225-49. Review.
Wang et al., Genetic screens in human cells using the CRISPR-Cas9 system. Science. Jan. 3, 2014;343(6166):80-4. doi: 10.1126/science.1246981. Epub Dec. 12, 2013.
Wang et al., Highly efficient CRISPR/HDR-mediated knock-in for mouse embryonic stem cells and zygotes. Bio techniques. 2015:59,201-2;204;206-8.
Wang et al., N(6)-methyladenosine Modulates Messenger RNA Translation Efficiency. Cell. Jun. 4, 2015;161(6):1388-99. doi: 10.1016/j.cell.2015.05.014.
Wang et al., N6-methyladenosine-dependent regulation of messenger RNA stability. Nature. Jan. 2, 2014;505(7481):117-20. doi: 10.1038/nature12730. Epub Nov. 27, 2013.
Wang et al., Nucleation, propagation and cleavage of target RNAs in Ago silencing complexes. Nature. Oct. 8, 2009;461(7265):754-61. doi: 10.1038/nature08434.
Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang et al., Programming cells by multiplex genome engineering and accelerated evolution. Nature. Aug. 13, 2009;460(7257):894-8. Epub Jul. 26, 2009.
Wang et al., Reading RNA methylation codes through methyl-specific binding proteins. RNA Biol. 2014;11(6):669-72. doi: 10.4161/rna.28829. Epub Apr. 24, 2014.
Wang et al., Recombinase technology: applications and possibilities. Plant Cell Rep. Mar. 2011;30(3):267-85. doi: 10.1007/s00299-010-0938-1. Epub Oct. 24, 2010.
Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.
Wang et al., *Staphylococcus aureus* protein SAUGI acts as a uracil-DNA glycosylase inhibitor. Nucleic Acids Res. Jan. 2014;42(2):1354-64. doi: 10.1093/nar/gkt964. Epub Oct. 22, 2013.
Wang et al., Structural basis of N(6)-adenosine methylation by the METTL3-METTL14 complex. Nature. Jun. 23, 2016;534(7608):575-8. doi: 10.1038/nature18298. Epub May 25, 2016.
Wang et al., Targeted gene addition to a predetermined site in the human genome using a ZHN-based nicking enzyme. Genome Res. Jul. 2012;22(7):1316-26. doi: 10.1101/gr.122879.111. Epub Mar. 20, 2012.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric Cre recombinase with regulated directionality. Proc Natl Acad Sci U S A. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.
Watowich, The erythropoietin receptor: molecular structure and hematopoietic signaling pathways. J Investig Med. Oct. 2011;59(7):1067-72. doi: 10.2310/JIM.0b013e31820fb28c.
Waxman et al., Regulating excitability of peripheral afferents: emerging ion channel targets. Nat Neurosci. Feb. 2014;17(2):153-63. doi: 10.1038/nn.3602. Epub Jan. 28, 2014.
Weber et al., Assembly of designer TAL effectors by Golden Gate cloning. PLoS One. 2011;6(5):e19722. doi:10.1371/journal.pone.0019722. Epub May 19, 2011.
Weill et al., DNA polymerases in adaptive immunity. Nat Rev Immunol. Apr. 2008;8(4):302-12. doi: 10.1038/nri2281. Epub Mar. 14, 2008.
Weinberg et al., New Classes of Self-Cleaving Ribozymes Revealed by Comparative Genomics Analysis. Nat Chem Biol. Aug. 2015;11(8):606-10. doi: 10.1038/nchembio.1846. Epub Jul. 13, 2015.

(56) References Cited

OTHER PUBLICATIONS

Weinberg et al., The aptamer core of SAM-IV riboswitches mimics the ligand-binding site of SAM-I riboswitches. RNA. May 2008;14(5):822-8. doi: 10.1261/rna.988608. Epub Mar. 27, 2008.
Weinberger et al., Disease-causing mutations C277R and C277Y modify gating of human ClC-1 chloride channels in myotonia congenita. J Physiol. Aug. 1, 2012;590(Pt 15):3449-64. doi: 0.1113/jphysiol.2012.232785. Epub May 28, 2012.
Weinert et al., Unbiased detection of CRISPR off-targets in vivo using DISCOVER-Seq. Science. Apr. 19, 2019;364(6437):286-289. doi: 10.1126/science.aav9023. Epub Apr. 18, 2019.
Wen et al., Inclusion of a universal tetanus toxoid CD4(+) T cell epitope P2 significantly enhanced the immunogenicity of recombinant rotavirus ?VP8* subunit parenteral vaccines. Vaccine. Jul. 31, 2014;32(35):4420-4427. doi: 10.1016/j.vaccine.2014.06.060. Epub Jun. 21, 2014.
West et al., Gene expression in adeno-associated virus vectors: the effects of chimeric mRNA structure, helper virus, and adenovirus VA1 RNA. Virology. Sep. 1987;160(1):38-47. doi: 10.1016/0042-6822(87)90041-9.
Wharton et al., A new-specificity mutant of 434 repressor that defines an amino acid-base pair contact. Nature. Apr. 30-May 6, 1987;326(6116):888-91.
Wharton et al., Changing the binding specificity of a repressor by redesigning an alpha-helix. Nature. Aug. 15-21, 1985;316(6029):601-5.
Wheeler et al., The thermostability and specificity of ancient proteins. Curr Opin Struct Biol. Jun. 2016;38:37-43. doi: 10.1016/j.sbi.2016.05.015. Epub Jun. 9, 2016.
Wiedenheft et al., RNA-guided genetic silencing systems in bacteria and archaea. Nature. Feb. 15, 2012;482(7385):331-8. doi: 10.1038/nature10886. Review.
Wienert et al., KLF1 drives the expression of fetal hemoglobin in British HPFH. Blood. Aug. 10, 2017;130(6):803-807. doi: 10.1182/blood-2017-02-767400. Epub Jun. 28, 2017.
Wijesinghe et al., Efficient deamination of 5-methylcytosines in DNA by human APOBEC3A, but not by AID or APOBEC3G. Nucleic Acids Res. Oct. 2012;40(18):9206-17. doi: 10.1093/nar/gks685. Epub Jul. 13, 2012.
Wijnker et al., Managing meiotic recombination in plant breeding. Trends Plant Sci. Dec. 2008;13(12):640-6. doi: 10.1016/j.tplants.2008.09.004. Epub Oct. 22, 2008.
Williams et al., Assessing the accuracy of ancestral protein reconstruction methods. PLoS Comput Biol. Jun. 23, 2006;2(6):e69. doi: 10.1371/journal.pcbi.0020069. Epub Jun. 23, 2006.
Wilson et al., Assessing annotation transfer for genomics: quantifying the relations between protein sequence, structure and function through traditional and probabilistic scores. J Mol Biol 2000;297:233-49.
Wilson et al., Formation of infectious hybrid virions with gibbon ape leukemia virus and human T-cell leukemia virus retroviral envelope glycoproteins and the gag and pol proteins of Moloney murine leukemia vims. J Virol. May 1989;63(5):2374-8. doi: 10.1128/JVI.63.5.2374-2378.1989.
Wilson et al., In Vitro Selection of Functional Nucleic Acids. Annu Rev Biochem. 1999;68:611-47. doi: 10.1146/annurev.biochem.68.1.611.
Wilson et al., Kinase dynamics. Using ancient protein kinases to unravel a modern cancer drug's mechanism. Science. Feb. 20, 2015;347(6224):882-6. doi: 10.1126/science.aaa1823.
Winkler et al., An mRNA structure that controls gene expression by binding FMN. Proc Natl Acad Sci U S A. Dec. 10, 2002;99(25):15908-13. Epub Nov. 27, 2002.
Winkler et al., Control of gene expression by a natural metabolite-responsive ribozyme. Nature. Mar. 18, 2004;428(6980):281-6.
Winkler et al., Thiamine derivatives bind messenger RNAs directly to regulate bacterial gene expression. Nature. Oct. 31, 2002;419(6910):952-6. Epub Oct. 16, 2002.
Winoto et al., A novel, inducible and T cell-specific enhancer located at the 3' end of the T cell receptor alpha locus. EMBO J. Mar. 1989;8(3):729-33.
Winter et al., Drug Development. Phthalimide conjugation as a strategy for in vivo target protein degradation. Science. Jun. 19, 2015;348(6241):1376-81. doi:; 10.1126/science.aab1433. Epub May 21, 2015.
Winter et al., Targeted exon skipping with AAV-mediated split adenine base editors. Cell Discov. Aug. 20, 2019;5:41. doi: 10.1038/s41421-019-0109-7.
Wold, Replication protein A: a heterotrimeric, single-stranded DNA-binding protein required for eukaryotic DNA metabolism. Annu Rev Biochem. 1997;66:61-92. doi: 10.1146/annurev.biochem.66.1.61.
Wolf et al., tadA, an essential tRNA-specific adenosine deaminase from *Escherichia coli*. EMBO J. Jul. 15, 2002;21(14):3841-51.
Wolfe et al., Analysis of zinc fingers optimized via phage display: evaluating the utility of a recognition code. J Mol Biol. Feb. 5, 1999;285(5):1917-34.
Wong et al., A statistical analysis of random mutagenesis methods used for directed protein evolution. J Mol Biol. Jan. 27, 2006;355(4):858-71. Epub Nov. 17, 2005.
Wong et al., The Diversity Challenge in Directed Protein Evolution. Comb Chem High Throughput Screen. May 2006;9(4):271-88.
Wood et al., A genetic system yields self-cleaving inteins for bioseparations. Nat Biotechnol. Sep. 1999;17(9):889-92. doi: 10.1038/12879.
Wood et al., Targeted genome editing across species using ZFNs and TALENs. Science. Jul. 15, 2011;333(6040):307. doi: 10.1126/science.1207773. Epub Jun. 23, 2011.
WRIGHT et al., Continuous in vitro evolution of catalytic function. Science. Apr. 25, 1997;276(5312):614-7.
Wright et al., Rational design of a split-Cas9 enzyme complex. Proc Natl Acad Sci U S A. Mar. 10, 2015;112(10):2984-9. doi: 10.1073/pnas.1501698112. Epub Feb. 23, 2015.
Wu et al., Correction of a genetic disease in mouse via use of CRISPR-Cas9. Cell Stem Cell. Dec. 5, 2013;13(6):659-62. doi: 10.1016/j.stem.2013.10.016.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Wu et al., Human single-stranded DNA binding proteins: guardians of genome stability. Acta Biochim Biophys Sin (Shanghai). Jul. 2016;48(7):671-7. doi: 10.1093/abbs/gmw044. Epub May 23, 2016.
Wu et al., Protein trans-splicing and functional mini-inteins of a cyanobacterial dnaB intein. Biochim Biophys Acta. Sep. 8, 1998;1387(1-2):422-32. doi: 10.1016/s0167-4838(98)00157-5.
Wu et al., Protein trans-splicing by a split intein encoded in a split DnaE gene of *Synechocystis* sp. PCC6803. Proc Natl Acad Sci U S A. Aug. 4, 1998;95(16):9226-31. doi: 10.1073/pnas.95.16.9226.
Wu et al., Readers, writers and erasers of N6-methylated adenosine modification. Curr Opin Struct Biol. Dec. 2017;47:67-76. doi: 10.1016/j.sbi.2017.05.011. Epub Jun. 16, 2017.
Xiang et al., RNA m6A methylation regulates the ultraviolet-induced DNA damage response. Nature. Mar. 23, 2017;543(7646):573-576. doi: 10.1038/nature21671. Epub Mar. 15, 2017.
Xiao et al., Genetic incorporation of multiple unnatural amino acids into proteins in mammalian cells. Angew Chem Int Ed Engl. Dec. 23, 2013;52(52):14080-3. doi: 10.1002/anie.201308137. Epub Nov. 8, 2013.
Xiao et al., Nuclear m(6)A Reader YTHDC1 Regulates mRNA Splicing. Mol Cell. Feb. 18, 2016;61(4):507-519. doi: 10.1016/j.molcel.2016.01.012. Epub Feb. 11, 2016.
Xie et al., Adjusting the attB site in donor plasmid improves the efficiency of ?C31 integrase system. DNA Cell Biol. Jul. 2012;31(7):1335-40. doi: 10.1089/dna.2011.1590. Epub Apr. 10, 2012.
Xiong et al., Origin and evolution of retroelements based upon their reverse transcriptase sequences. EMBO J. Oct. 1990;9(10):3353-62.
Xu et al., Chemical ligation of folded recombinant proteins: segmental isotopic labeling of domains for NMR studies. Proc Natl Acad Sci U S A. Jan. 19, 1999;96(2):388-93. doi: 10.1073/pnas.96.2.388.

(56) References Cited

OTHER PUBLICATIONS

Xu et al., Accuracy and efficiency define Bxb1 integrase as the best of fifteen candidate serine recombinases for the integration of DNA into the human genome. BMC Biotechnol. Oct. 20, 2013;13:87. doi: 10.1186/1472-6750-13-87.
Xu et al., Protein splicing: an analysis of the branched intermediate and its resolution by succinimide formation. EMBO J. Dec. 1, 1994;13(23):5517-22.
Xu et al., PTMD: A Database of Human Disease-associated Post-translational Modifications. Genomics Proteomics Bioinformatics. Aug. 2018;16(4):244-251. doi: 10.1016/j.gpb.2018.06.004. Epub Sep. 21, 2018.
Xu et al., Sequence determinants of improved CRISPR sgRNA design. Genome Res. Aug. 2015;25(8):1147-57. doi: 10.1101/gr.191452.115. Epub Jun. 10, 2015.
Xu et al., Structures of human ALKBH5 demethylase reveal a unique binding mode for specific single-stranded N6-methyladenosine RNA demethylation. J Biol Chem. Jun. 20, 2014;289(25):17299-311. doi: 10.1074/jbc.M114.550350. Epub Apr. 28, 2014.
Xu et al., The mechanism of protein splicing and its modulation by mutation. EMBO J. Oct. 1, 1996;15(19):5146-53.
Yahata et al., Unified, Efficient, and Scalable Synthesis of Halichondrins: Zirconium/Nickel-Mediated One-Pot Ketone Synthesis as the Final Coupling Reaction. Angew Chem Int Ed Engl. Aug. 28, 2017;56(36):10796-10800. doi: 10.1002/anie.201705523. Epub Jul. 28, 2017.
Yamamoto et al., The ons and offs of inducible transgenic technology: a review. Neurobiol Dis. Dec. 2001;8(6):923-32.
Yamamoto et al., Virological and immunological bases for HIV-1 vaccine design. Uirusu 2007;57(2):133-139. https://doi.org/10.2222/jsv.57.133.
Yamano et al., Crystal Structure of Cpf1 in Complex with Guide RNA and Target DNA. Cell May 2016;165(4)949-62.
Yamazaki et al., Segmental Isotope Labeling for Protein NMR Using Peptide Splicing. J. Am. Chem. Soc. May 22, 1998; 120(22):5591-2. https://doi.org/10.1021/ja980776o.
Yan et al., Cas13d Is a Compact RNA-Targeting Type VI CRISPR Effector Positively Modulated by a WYL-Domain-Containing Accessory Protein. Mol Cell. Apr. 19, 2018;70(2):327-339.e5. doi: 10.1016/j.molcel.2018.02.028. Epub Mar. 15, 2018.
Yang et al., APOBEC: From mutator to editor. J Genet Genomics. Sep. 20, 2017;44(9):423-437. doi: 10.1016/j.jgg.2017.04.009. Epub Aug. 7, 2017.
Yang et al., Construction of an integration-proficient vector based on the site-specific recombination mechanism of enterococcal temperate phage phiFC1. J Bacteriol. Apr. 2002;184(7):1859-64. doi: 10.1128/jb.184.7.1859-1864.2002.
Yang et al., Engineering and optimising deaminase fusions for genome editing. Nat Commun. Nov. 2, 2016;7:13330. doi: 10.1038/ncomms13330.
Yang et al., Genome editing with targeted deaminases. BioRxiv. Preprint. First posted online Jul. 28, 2016.
Yang et al., Increasing targeting scope of adenosine base editors in mouse and rat embryos through fusion of TadA deaminase with Cas9 variants. Protein Cell. Sep. 2018;9(9):814-819. doi: 10.1007/s13238-018-0568-x.
Yang et al., New CRISPR-Cas systems discovered. Cell Res. Mar. 2017;27(3):313-314. doi: 10.1038/cr.2017.21. Epub Feb. 21, 2017.
Yang et al., One-step generation of mice carrying reporter and conditional alleles by CRISPR/Cas-mediated genome engineering. Cell. Sep. 12, 2013;154(6):1370-9. doi: 10.1016/j.cell.2013.08.022. Epub Aug. 29, 2013.
Yang et al., PAM-dependent Target DNA Recognition and Cleavage by C2C1 CRISPR-Cas endonuclease. Cell Dec. 2016;167(7):1814-28.
Yang et al., Permanent genetic memory with >1-byte capacity. Nat Methods. Dec. 2014;11(12):1261-6. doi: 10.1038/nmeth.3147. Epub Oct. 26, 2014.
Yang et al., Preparation of RNA-directed DNA polymerase from spleens of Balb-c mice infected with Rauscher leukemia virus. Biochem Biophys Res Commun. Apr. 28, 1972;47(2):505-11. doi: 10.1016/0006-291x(72)90743-7.
Yang et al., Small-molecule control of insulin and PDGF receptor signaling and the role of membrane attachment. Curr Biol. Jan. 1, 1998;8(1):11-8. doi: 10.1016/s0960-9822(98)70015-6.
Yang, Nucleases: diversity of structure, function and mechanism. Q Rev Biophys. Feb. 2011;44(1):1-93. doi: 10.1017/S0033583510000181. Epub Sep. 21, 2010.
Yang, PAML 4: phylogenetic analysis by maximum likelihood. Mol Biol Evol. Aug. 2007;24(8):1586-91. doi: 10.1093/molbev/msm088. Epub May 4, 2007.
Yanover et al., Extensive protein and DNA backbone sampling improves structure-based specificity prediction for C2H2 zinc fingers. Nucleic Acids Res. Jun. 2011;39(111):4564-76. doi: 10.1093/nar/gkr048. Epub Feb. 22, 2011.
Yasui et al., Miscoding Properties of 2'-Deoxyinosine, a Nitric Oxide-Derived DNA Adduct, during Translesion Synthesis Catalyzed by Human DNA Polymerases. J Molec Biol. Apr. 4, 2008;377(4):1015-23.
Yasui, Alternative excision repair pathways. Cold Spring Harb Perspect Biol. Jun. 1, 2013;5(6):a012617. doi: 10.1101/cshperspect.a012617.
Yasukawa et al., Characterization of Moloney murine leukaemia virus/avian myeloblastosis virus chimeric reverse transcriptases. J Biochem. Mar. 2009;145(3):315-24. doi: 10.1093/jb/mvn166. Epub Dec. 6, 2008.
Yazaki et al., Hereditary systemic amyloidosis associated with a new apolipoprotein AII stop codon mutation Stop78Arg. Kidney Int. Jul. 2003;64(1):11-6.
Yeh et al., In vivo base editing of post-mitotic sensory cells. Nat Commun. Jun. 5, 2018;9(1):2184. doi: 10.1038/s41467-018-04580-3.
Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.
Yokoe et al., Spatial dynamics of GFP-tagged proteins investigated by local fluorescence enhancement. Nat Biotechnol. Oct. 1996;14(10):1252-6. doi: 10.1038/nbt1096-1252.
Young et al., Beyond the canonical 20 amino acids: expanding the genetic lexicon. J Biol Chem. Apr. 9, 2010;285(15):11039-44. doi: 10.1074/jbc.R109.091306. Epub Feb. 10, 2010.
Yu et al., Circular permutation: a different way to engineer enzyme structure and function. Trends Biotechnol. Jan. 2011;29(1):18-25. doi: 10.1016/j.tibtech.2010.10.004. Epub Nov. 17, 2010.
Yu et al., Liposome-mediated in vivo E1A gene transfer suppressed dissemination of ovarian cancer cells that overexpress HER-2/neu. Oncogene. Oct. 5, 1995;11(7):1383-8.
Yu et al., Progress towards gene therapy for HIV infection. Gene Ther. Jan. 1994;1(1):13-26.
Yu et al., Small molecules enhance CRISPR genome editing in pluripotent stem cells. Cell Stem Cell. Feb. 5, 2015;16(2):142-7. doi: 10.1016/j.stem.2015.01.003.
Yu et al., Synthesis-dependent microhomology-mediated end joining accounts for multiple types of repair junctions. Nucleic Acids Res. Sep. 2010;38(17):5706-17. doi: 10.1093/nar/gkq379. Epub May 11, 2010.
Yuan et al., Laboratory-directed protein evolution. Microbiol Mol Biol Rev. 2005; 69(3):373-92. PMID: 16148303.
Yuan et al., Tetrameric structure of a serine integrase catalytic domain. Structure. Aug. 6, 2008;16(8):1275-86. doi: 10.1016/j.str.2008.04.018.
Yuen et al., Control of transcription factor activity and osteoblast differentiation in mammalian cells using an evolved small-molecule-dependent intein. J Am Chem Soc. Jul. 12, 2006;128(27):8939-46.
Zakas et al., Enhancing the pharmaceutical properties of protein drugs by ancestral sequence reconstruction. Nat Biotechnol. Jan. 2017;35(1):35-37. doi: 10.1038/nbt.3677. Epub Sep. 26, 2016.
Zalatan et al., Engineering complex synthetic transcriptional programs with CRISPR RNA scaffolds. Cell. Jan. 15, 2015;160(1-2):339-50. doi: 10.1016/j.cell.2014.11.052. Epub Dec. 18, 2014.

(56) References Cited

OTHER PUBLICATIONS

Zelphati et al., Intracellular delivery of proteins with a new lipid-mediated delivery system. J Biol Chem. Sep. 14, 2001;276(37):35103-10. Epub Jul. 10, 2001.
Zetsche et al., A split-Cas9 architecture for inducible genome editing and transcription modulation. Nat Biotechnol. Feb. 2015;33(2):139-42. doi: 10.1038/nbt.3149.
Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.
Zettler et al., The naturally split Npu DnaE intein exhibits an extraordinarily high rate in the protein trans-splicing reaction. FEBS Lett. Mar. 4, 2009;583(5):909-14. doi: 10.1016/j.febslet.2009.02.003. Epub Feb. 10, 2009.
Zhang et al., Π-Clamp-mediated cysteine conjugation. Nat Chem. Feb. 2016;8(2):120-8. doi: 10.1038/nchem.2413. Epub Dec. 21, 2015.
Zhang et al., A new strategy for the site-specific modification of proteins in vivo. Biochemistry. Jun. 10, 2003;42(22):6735-46.
Zhang et al., Circular intronic long noncoding RNAs. Mol Cell. Sep. 26, 2013;51(6):792-806. doi: 10.1016/j.molcel.2013.08.017. Epub Sep. 12, 2013.
Zhang et al., Comparison of non-canonical PAMs for CRISPR/Cas9-mediated DNA cleavage in human cells. Sci Rep. Jun. 2014;4:5405.
Zhang et al., Conditional gene manipulation: Cre-ating a new biological era. J Zhejiang Univ Sci B. Jul. 2012;13(7):511-24. doi: 10.1631/jzus.B1200042. Review.
Zhang et al., Copy number variation in human health, disease, and evolution. Annu Rev Genomics Hum Genet. 2009;10:451-81. doi: 10.1146/annurev.genom.9.081307.164217.
Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.
Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.
Zhang et al., Myoediting: Toward Prevention of Muscular Dystrophy by Therapeutic Genome Editing. Physiol Rev. Jul. 1, 2018;98(3):1205-1240. doi: 10.1152/physrev.00046.2017.
Zhang et al., Ribozymes and Riboswitches: Modulation of RNA Function by Small Molecules. Biochemistry. Nov. 2, 2010;49(43):9123-31. doi: 10.1021/bi1012645.
Zhang et al., Stabilized plasmid-lipid particles for regional gene therapy: formulation and transfection properties. Gene Ther. Aug. 1999;6(8):1438-47.
Zhao et al., An ultraprocessive, accurate reverse transcriptase encoded by a metazoan group II intron. RNA. Feb. 2018;24(2):183-195. doi: 10.1261/rna.063479.117. Epub Nov. 6, 2017.
Zhao et al., Crystal structures of a group II intron maturase reveal a missing link in spliceosome evolution. Nat Struct Mol Biol. Jun. 2016;23(6):558-65. doi: 10.1038/nsmb.3224. Epub May 2, 2016.
Zhao et al., Post-transcriptional gene regulation by mRNA modifications. Nat Rev Mol Cell Biol. Jan. 2017;18(1):31-42. doi: 10.1038/nrm.2016.132. Epub Nov. 3, 2016.
Zheng et al., ALKBH5 is a mammalian RNA demethylase that impacts RNA metabolism and mouse fertility. Mol Cell. Jan. 10, 2013;49(1):18-29. doi: 10.1016/j.molcel.2012.10.015. Epub Nov. 21, 2012.
Zheng et al., DNA editing in DNA/RNA hybrids by adenosine deaminases that act on RNA. Nucleic Acids Res. Apr. 7, 2017;45(6):3369-3377. doi: 10.1093/nar/gkx050.
Zheng et al., Highly efficient base editing in bacteria using a Cas9-cytidine deaminase fusion. Commun Biol. Apr. 19, 2018;1:32. doi: 10.1038/s42003-018-0035-5.
Zheng et al., Structural basis for the complete resistance of the human prion protein mutant G127V to prion disease. Sci Rep. Sep. 4, 2018;8(1):13211. doi: 10.1038/s41598-018-31394-6.
Zhong et al., Rational Design of Aptazyme Riboswitches for Efficient Control of Gene Expression in Mammalian Cells. Elife. Nov. 2, 2016;5:e18858. doi: 10.7554/eLife.18858.
Zhou et al., Dynamic m(6)A mRNA methylation directs translational control of heat shock response. Nature. Oct. 22, 2015;526(7574):591-4. doi: 10.1038/nature15377. Epub Oct. 12, 2015.
Zhou et al., Off-target RNA mutation induced by DNA base editing and its elimination by mutagenesis. Nature. Jul. 2019;571(7764):275-278. doi: 10.1038/s41586-019-1314-0. Epub Jun. 10, 2019.
Zhou et al., Protective V127 prion variant prevents prion disease by interrupting the formation of dimer and fibril from molecular dynamics simulations. Sci Rep. Feb. 24, 2016;6:21804. doi: 10.1038/srep21804.
Zhou et al., Seamless Genetic Conversion of SMN2 to SMN1 via CRISPR/Cpf1 and Single-Stranded Oligodeoxynucleotides in Spinal Muscular Atrophy Patient-Specific Induced Pluripotent Stem Cells. Hum Gene Ther. Nov. 2018;29(11):1252-1263. doi: 10.1089/hum.2017.255. Epub May 9, 2018.
Ztelenski, Genotype and phenotype in cystic fibrosis. Respiration. 2000;67(2):117-33. doi: 10.1159/000029497.
Zimmerly et al., An Unexplored Diversity of Reverse Transcriptases in Bacteria. Microbiol Spectr. Apr. 2015;3(2):MDNA3-0058-2014. doi: 10.1128/microbiolspec.MDNA3-0058-2014.
Zlmmerly et al., Group II intron mobility occurs by target DNA-primed reverse transcription. Cell. Aug. 25, 1995;82(4):545-54. doi: 10.1016/0092-8674(95)90027-6.
Zimmermann et al., Molecular interactions and metal binding in the theophylline-binding core of an RNA aptamer. RNA. May 2000;6(5):659-67.
Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.
Zorko et al., Cell-penetrating peptides: mechanism and kinetics of cargo delivery. Adv Drug Deliv Rev. Feb. 28, 2005;57(4):529-45. Epub Jan. 22, 2005.
Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.
Zufferey et al., Woodchuck hepatitis virus posttranscriptional regulatory element enhances expression of transgenes delivered by retroviral vectors. J Virol. Apr. 1999;73(4):2886-92. doi: 10.1128/JVI.73.4.2886-2892.1999.
Zuker et al., Optimal computer folding of large RNA sequences using thermodynamics and auxiliary information. Nucleic Acids Res. Jan. 10, 1981;9(1):133-48. doi: 10.1093/nar/9.1.133.
Zuo et al., Cytosine base editor generates substantial off-target single-nucleotide variants in mouse embryos. Science. Apr. 19, 2019;364(6437):289-292. doi: 10.1126/science.aav9973. Epub Feb. 28, 2019.
Zuris et al., Cationic lipid-mediated delivery of proteins enables efficient protein-based genome editing in vitro and in vivo. Nat Biotechnol. 2015;33:73-80.
[No Author Listed] NCBI Reference Sequence: WP_00087959824.1. Oct. 9, 2019. 2 pages.
Akopian et al., Chimeric recombinases with designed DNA sequence recognition. Proc Natl Acad Sci USA. Jul. 22, 2003;100(15):8688-91. Epub Jul. 1, 2003.
André et al., Axotomy-induced expression of calcium-activated chloride current in subpopulations of mouse dorsal root ganglion neurons. J Neurophysiol. Dec. 2003;90(6):3764-73. doi: 10.1152/jn.00449.2003. Epub Aug. 27, 2003.
Benarroch, HCN channels: function and clinical implications. Neurology. Jan. 15, 2013;80(3):304-10. doi: 10.1212/WNL.0b013e31827dec42.
Berges et al., Transduction of brain by herpes simplex virus vectors. Mol Ther. Jan. 2007;15(1):20-9. doi: 10.1038/sj.mt.6300018.
Bhagwat, DNA-cytosine deaminases: from antibody maturation to antiviral defense. DNA Repair (Amst). Jan. 5, 2004;3(1):85-9.

(56) References Cited

OTHER PUBLICATIONS

Bourinet et al., Silencing of the Cav3.2 T-type calcium channel gene in sensory neurons demonstrates its major role in nociception. EMBO J. Jan. 26, 2005;24(2):315-24. doi: 10.1038/sj.emboj.7600515. Epub Dec. 16, 2004.
Burke et al., Activating mutations of Tn3 resolvase marking interfaces important in recombination catalysis and its regulation. Mol Microbiol. Feb. 2004;51(4):937-48.
Burton et al., Gene delivery using herpes simplex virus vectors. DNA Cell Biol. Dec. 2002;21(12):915-36. doi: 10.1089/104454902762053864.
Chari et al., Unraveling CRISPR-Cas9 genome engineering parameters via a library-on-library approach. Nat Methods. Sep. 2015;12(9):823-6. doi: 10.1038/nmeth.3473. Epub Jul. 13, 2015.
Chavez et al., Precise Cas9 targeting enables genomic mutation prevention. bioRxiv. Jun. 14, 2016; //dx/doi.oreg/10.1101/058974. 6 pages. bioRxiv preprint first posted online Jun. 14, 2016.
Chavez et al., Therapeutic applications of the ?C31 integrase system. Curr Gene Ther. Oct. 2011;11(5):375-81. Review.
Chen et al., Genome-wide CRISPR screen in a mouse model of tumor growth and metastasis. Cell. Mar. 12, 2015; 160(6): 1246-60. doi: 10.1016/j.cell.2015.02.038. Epub Mar. 5, 2015.
Chester et al., The apolipoprotein B mRNA editing complex performs a multifunctional cycle and suppresses nonsense-mediated decay. EMBO J. Aug. 1, 2003;22(15):3971-82. doi: 10.1093/emboj/cdg369.
Cho et al., The calcium-activated chloride channel anoctamin 1 acts as a heat sensor in nociceptive neurons. Nat Neurosci. May 27, 2012;15(7):1015-21. doi: 10.1038/nn.3111.
Coffey et al., The Economic Impact of BSE on the U.S. Beef Industry: Product Value Losses, Regulatory Costs, and Consumer Reactions. Kansas State University Agricultural Experiment Station and Cooperative Extension Service. MF-2678. May 2005. 68 pages. Accessed via //bookstore.ksre.ksu.edu/pubs/MF2678.pdf.
Cox et al., An SCN9A channelopathy causes congenital inability to experience pain. Nature. Dec. 14, 2006;444(7121):894-8. doi: 10.1038/nature05413.
Cox et al., Congenital insensitivity to pain: novel SCN9A missense and in-frame deletion mutations. Hum Mutat. Sep. 2010;31(9):E1670-86. doi: 10.1002/humu.21325.
Cronican et al., A class of human proteins that deliver functional proteins into mammalian cells in vitro and in vivo. Chem Biol. Jul. 29, 2011;18(7):833-8. doi: 10.1016/j.chembiol.2011.07.003.
Cronican et al., Potent delivery of functional proteins into mammalian cells in vitro and in vivo using a supercharged protein. ACS Chem Biol. Aug. 20, 2010;5(8):747-52. doi: 10.1021/cb1001153.
DataBase EBI Accession No. ADE34233 Jan. 29, 2004.
DataBase EBI Accession No. BFF09785. May 31, 2018. 2 pages.
DataBase EBI Accession No. BGE38086. Jul. 25, 2019. 2 pages.
DataBase UniProt Accession No. G8I3E0. Jan. 14, 2012.
Davidson et al., Viral vectors for gene delivery to the nervous system. Nat Rev Neurosci. May 2003;4(5):353-64. doi: 10.1038/nrn1104.
Deverman et al., Cre-dependent selection yields AAV variants for widespread gene transfer to the adult brain. Nat Biotechnol. Feb. 2016;34(2):204-9. doi: 10.1038/nbt.3440. Epub Feb. 1, 2016.
Devigili et al., Paroxysmal itch caused by gain-of-function Nav1.7 mutation. Pain. Sep. 2014;155(9):1702-1707. doi: 10.1016/j.pain.2014.05.006. Epub May 10, 2014.
Doench et al., Rational design of highly active sgRNAs for CRISPR-Cas9-mediated gene inactivation. Nat Biotechnol. Dec. 2014;32(12):1262-7. doi: 10.1038/nbt.3026. Epub Sep. 3, 2014.
Emery et al., HCN2 ion channels play a central role in inflammatory and neuropathic pain. Science. Sep. 9, 2011;333(6048):1462-6. doi: 10.1126/science.1206243.
Epstein, HSV-1-based amplicon vectors: design and applications. Gene Ther. Oct. 2005;12 Suppl 1:S154-8. doi: 10.1038/sj.gt.3302617.
Farboud et al., Dramatic enhancement of genome editing by CRISPR/Cas9 through improved guide RNA design. Genetics. Apr. 2015;199(4):959-71. doi: 10.1534/genetics.115.175166. Epub Feb. 18, 2015.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013. Including Supplementary Information.
Fusi et al., In Silico Predictive Modeling of CRISPR/Cas9 guide efficiency. Jun. 26, 2015; bioRxiv. //dx.doi.org/10.1101/021568.
Gaj et al., Structure-guided reprogramming of serine recombinase DNA sequence specificity. Proc Natl Acad Sci USA. Jan. 11, 2011;108(2):498-503. doi: 10.1073/pnas.1014214108. Epub Dec. 27, 2010.
GenBank Submission; NIH/NCBI, Accession No. BDB43378. Zhang et al., Aug. 11, 2016. 2 pages.
GenBank Submission; NIH/NCBI, Accession No. NM_002945.3. Weiser et al., Sep. 3, 2017. 5 pages.
GenBank Submission; NIH/NCBI, Accession No. NM_002947.4. Xiao et al., May 1, 2019. 4 pages.
GenBank Submission; NIH/NCBI, Accession No. NP_358988.1. Hoskins et al., Jan. 11, 2017. 2 pages.
GenBank Submission; NIH/NCBI, Accession No. NP_628093.1. Hsiao et al., Aug. 3, 2016. 2 pages.
GenBank Submission; NIH/NCBI, Accession No. YP_009137104.1. Davison, Aug. 13, 2018. 2 pages.
Goldberg et al., Loss-of-function mutations in the Nav1.7 gene underlie congenital indifference to pain in multiple human populations. Clin Genet. Apr. 2007;71(4):311-9. doi: 10.1111/j.1399-0004.2007.00790.x.
Gordley et al., Evolution of programmable zinc finger-recombinases with activity in human cells. J Mol Biol. Mar. 30, 2007;367(3):802-13. Epub Jan. 12, 2007.
Gordley et al., Synthesis of programmable integrases. Proc Natl Acad Sci U S A. Mar. 31, 2009;106(13):5053-8. doi: 10.1073/pnas.0812502106. Epub Mar. 12, 2009.
Grindley et al., Mechanisms of site-specific recombination. Annu Rev Biochem. 2006;75:567-605. doi: 10.1146/annurev.biochem.73.011303.073908.
Groth et al., Phage integrases: biology and applications. J Mol Biol. Jan. 16, 2004;335(3):667-78.
Gruber et al., The Vienna RNA websuite. Nucleic Acids Res. Jul. 1, 2008;36(Web Server issue):W70-4. doi: 10.1093/nar/gkn188. Epub Apr. 19, 2008.
Guo et al., Structure of Cre recombinase complexed with DNA in a site-specific recombination synapse. Nature. Sep. 4, 1997;389(6646):40-6.
Harrington et al., A thermostable Cas9 with increased lifetime in human plasma. Nat Commun. Nov. 10, 2017;8(1):1424. doi: 10.1038/s41467-017-01408-4. Posted May 16, 2017 as bioRxiv preprint. Doi.org/10.1101/138867.
Hartung et al., Cre mutants with altered DNA binding properties. J Biol Chem. Sep. 4, 1998;273(36):22884-91.
Hirano et al., Site-specific recombinases as tools for heterologous gene integration. Appl Microbiol Biotechnol. Oct. 2011;92(2):227-39. doi: 10.1007/s00253-011-3519-5. Epub Aug. 7, 2011. Review.
Hoess et al., DNA specificity of the Cre recombinase resides in the 25 kDa carboxyl domain of the protein. J Mol Biol. Dec. 20, 1990;216(4):873-82. doi: 10.1016/S0022-2836(99)80007-2.
Holt et al., Human hematopoietic stem/progenitor cells modified by zinc-finger nucleases targeted to CCR5 control HIV-1 in vivo. Nat Biotechnol. Aug. 2010;28(8):839-47. doi: 10.1038/nbt.1663. Epub Jul. 2, 2010.
Hotta et al., [Neurotropic viruses—classification, structure and characteristics]. Nihon Rinsho. Apr. 1997;55(4):777-82. Japanese.
Housden et al., Identification of potential drug targets for tuberous sclerosis complex by synthetic screens combining CRISPR-based knockouts with RNAi. Sci Signal. Sep. 8, 2015;8(393):rs9. doi: 10.1126/scisignal.aab3729.
Kay et al., Viral vectors for gene therapy: the art of turning infectious agents into vehicles of therapeutics. Nat Med. Jan. 2001;7(1):33-40.

(56) References Cited

OTHER PUBLICATIONS

Kilbride et al., Determinants of product topology in a hybrid Cre-Tn3 resolvase site-specific recombination system. J Mol Biol. Jan. 13, 2006;355(2):185-95. Epub Nov. 9, 2005.
Kim et al., In vivo genome editing with a small Cas9 orthologue derived from Campylobacter jejuni. Nat Commun. Feb. 21, 2017;8:14500. doi: 10.1038/ncomms14500. PMID: 28220790; PMCID: PMC5473640.
Lancaster et al., Limited trafficking of a neurotropic virus through inefficient retrograde axonal transport and the type I interferon response. PLoS Pathog. Mar. 5, 2010;6(3):e1000791. doi: 10.1371/journal.ppat.1000791.
Leipold et al., A de novo gain-of-function mutation in SCN11A causes loss of pain perception. Nat Genet. Nov. 2013;45(11):1399-404. doi: 10.1038/ng.2767. Epub Sep. 15, 2013.
Lim et al., Viral vectors for neurotrophic factor delivery: a gene therapy approach for neurodegenerative diseases of the CNS. Pharmacol Res. Jan. 2010;61(1):14-26. doi: 10.1016/j.phrs.2009.10.002. Epub Oct. 17, 2009.
Maizels et al., Initiation of homologous recombination at DNA nicks. Nucleic Acids Res. Aug. 21, 2018;46(14):6962-6973. doi: 10.1093/nar/gky588.
Makarova et al., Prokaryotic homologs of Argonaute proteins are predicted to function as key components of a novel system of defense against mobile genetic elements. Biology Direct 2009;4:29. doi: 10.1186/1745-6150-4-29.
Marzec et al., Prime Editing: A New Way for Genome Editing. Trends Cell Biol. Apr. 2020;30(4):257-259. doi: 10.1016/j.tcb.2020.01.004. Epub Jan. 27, 2020.
Mcnaughton et al., Mammalian cell penetration, siRNA transfection, and DNA transfection by supercharged proteins. Proc Natl Acad Sci U S A. Apr. 14, 2009;106(15):6111-6. doi: 10.1073/pnas.0807883106. Epub Mar. 23, 2009.
Mir et al., Type II-C CRISPR-Cas9 Biology, Mechanism, and Application. ACS Chem Biol. Feb. 16, 2018;13(2):357-365. doi: 10.1021/acschembio.7b00855. Epub Dec. 20, 2017.
Moreno-Mateos et al., CRISPRscan: designing highly efficient sgRNAs for CRISPR-Cas9 targeting in vivo. Nat Methods. Oct. 2015;12(10):982-8. doi: 10.1038/nmeth.3543. Epub Aug. 31, 2015.
Mougiakos et al., Characterizing a thermostable Cas9 for bacterial genome editing and silencing. Nat Commun. Nov. 21, 2017;8(1):1647. doi: 10.1038/s41467-017-01591-4.
Murphy, Phage recombinases and their applications. Adv Virus Res. 2012;83:367-414. doi: 10.1016/B978-0-12-394438-2.00008-6. Review.
Olorunniji et al., Synapsis and catalysis by activated Tn3 resolvase mutants. Nucleic Acids Res. Dec. 2008;36(22):7181-91. doi: 10.1093/nar/gkn885. Epub Nov. 10, 2008.
Reynaud et al., What role for AID: mutator, or assembler of the immunoglobulin mutasome? Nat Immunol. Jul. 2003;4(7):631-8.
Rongrong et al., Effect of deletion mutation on the recombination activity of Cre recombinase. Acta Biochim Pol. 2005;52(2):541-4. Epub May 15, 2005.
Sapunar et al., Dorsal root ganglion—a potential new therapeutic target for neuropathic pain. J Pain Res. 2012;5:31-8. doi: 10.2147/JPR.S26603. Epub Feb. 16, 2012.
Shaikh et al., Chimeras of the Flp and Cre recombinases: tests of the mode of cleavage by Flp and Cre. J Mol Biol. Sep. 8, 2000;302(1):27-48.
Shen et al., Herpes simplex virus 1 (HSV-1) for cancer treatment. Cancer Gene Ther. Nov. 2006;13(11):975-92. doi: 10.1038/sj.cgt.7700946. Epub Apr. 7, 2006.
Singh et al., Real-time observation of DNA target interrogation and product release by the RNA-guided endonuclease CRISPR Cpf1 (Cas12a). Proc Natl Acad Sci U S A. May 22, 2018;115(21):5444-5449. doi: 10.1073/pnas.1718686115. Epub May 7, 2018.
Smith et al., Diversity in the serine recombinases. Mol Microbiol. Apr. 2002;44(2):299-307. Review.
Smith et al., Herpesvirus transport to the nervous system and back again. Annu Rev Microbiol. 2012;66:153-76. doi: 10.1146/annurev-micro-092611-150051. Epub Jun. 15, 2012.
Steiner et al., The neurotropic herpes viruses: herpes simplex and varicella-zoster. Lancet Neurol. Nov. 2007;6(11):1015-28. doi: 10.1016/S1474-4422(07)70267-3.
Strecker et al., Engineering of CRISPR-Cas12b for human genome editing. Nat Commun. Jan. 22, 2019;10(1):212. doi: 10.1038/s41467-018-08224-4.
Sudarsan et al., Riboswitches in eubacteria sense the second messenger cyclic di-GMP. Science. Jul. 18, 2008;321(5887):411-3. doi: 10.1126/science.1159519.
Teng et al., Mutational analysis of apolipoprotein B mRNA editing enzyme (APOBEC1). structure-function relationships of RNA editing and dimerization. J Lipid Res. Apr. 1999;40(4):623-35.
UniProt Consortium, UniProt: the universal protein knowledgebase. Nucleic Acids Res. Mar. 16, 2018;46(5):2699. doi: 10.1093/nar/gky092.
Venken et al., Genome-wide manipulations of *Drosophila melanogaster* with transposons, Flp recombinase, and ΦC31 integrase. Methods Mol Biol. 2012;859:203-28. doi: 10.1007/978-1-61779-603-6_12.
Wang et al., Optimized paired-sgRNA/Cas9 cloning and expression cassette triggers high-efficiency multiplex genome editing in kiwifruit. Plant Biotechnol J. Aug. 2018;16(8):1424-1433. doi: 10.1111/pbi.12884. Epub Feb. 6, 2018.
Weiss et al., Loss-of-function mutations in sodium channel Nav1.7 cause anosmia. Nature. Apr. 14, 2011;472(7342):186-90. doi: 10.1038/nature09975. Epub Mar. 23, 2011.
Woods et al., The phenotype of congenital insensitivity to pain due to the NaV1.9 variant p.L811P. Eur J Hum Genet. May 2015;23(5):561-3. doi: 10.1038/ejhg.2014.166. Epub Aug. 13, 2014.
Xu et al., Multiplex nucleotide editing by high-fidelity Cas9 variants with improved efficiency in rice. BMC Plant Biol. 2019;19(1):511. Published Nov. 21, 2019. doi: 10.1186/s12870-019-2131-1. Includes supplementary data and materials.
Yamada et al., Crystal Structure of the Minimal Cas9 from Campylobacter jejuni Reveals the Molecular Diversity in the CRISPR-Cas9 Systems. Mol Cell. Mar. 16, 2017;65(6):P1109-1121. /doi.org/10.1016/j.molcel.2017.02.007.
Yamano et al., Crystal Structure of Cpf1 in Complex with Guide RNA and Target DNA. Cell. May 5, 2016;165(4):949-62 and Supplemental Info, doi: 10.1016/j.cell.2016.04.003. Epub Apr. 21, 2016.
Yan et al., Functionally diverse type V CRISPR-Cas systems. Science. Jan. 4, 2019;363(6422):88-91. doi: 10.1126/science.aav7271. Epub Dec. 6, 2018.
Yang et al., Mutations in SCN9A, encoding a sodium channel alpha subunit, in patients with primary erythermalgia. J Med Genet. Mar. 2004;41(3):171-4. doi: 10.1136/jmg.2003.012153.
Yang et al., One Prime for All Editing. Cell. Dec. 12, 2019;179(7):1448-1450. doi: 10.1016/j.cell.2019.11.030.
Yang, Development of Human Genome Editing Tools for the Study of Genetic Variations and Gene Therapies. Doctoral Dissertation. Harvard University. 2013. Accessible via nrs.harvard.edu/urn-3:HUL.InstRepos:11181072. 277 pages.
Zetsche et al., Cpf1 is a single RNA-guided endonuclease of a class 2 CRISPR-Cas system. Cell. Oct. 22, 2015;163(3):759-71 and Supplemental Info, doi: 10.1016/j.cell.2015.09.038. Epub Sep. 25, 2015.
Zhang et al., Programmable base editing of zebrafish genome using a modified CRISPR-Cas9 system. Nat Commun. Jul. 25, 2017;8(1):118. doi: 10.1038/s41467-017-00175-6.

* cited by examiner

WT Hap1

| | A | C | T | G |
|---|---|---|---|---|
| BE3 | 7.029168 | 23.98752 | 0.311287 | 68.67203 |
| BE3_UdgX | 2.429073 | 26.86903 | 0.154274 | 70.54762 |
| BE3_UdgX* | 2.293083 | 24.10467 | 0.133893 | 73.46835 |
| BE2_UdgX_On | 0.597649 | 2.235434 | 0.088334 | 97.07858 |
| BE3_UdgX_On | 1.761788 | 19.16713 | 0.155196 | 78.91588 |
| BE2_UDG | 0.479271 | 1.871172 | 0.026613 | 97.62294 |
| BE3_UDG | 1.666401 | 13.09618 | 0.14136 | 85.09606 |

HEK2

| WT Hap1 | A | C | T | G |
|---|---|---|---|---|
| BE3 | 7.029168 | 23.98752 | 0.311287 | 68.67203 |
| BE3 | 5.872296 | 27.17249 | 0.27076 | 66.68446 |
| BE3_UdgX | 2.429073 | 26.86903 | 0.154274 | 70.54762 |
| BE3_UdgX | 2.908524 | 26.48944 | 0.438746 | 70.1633 |
| BE3_UdgX* | 2.293083 | 24.10467 | 0.133893 | 73.46835 |
| BE3_REV7 | 2.010573 | 12.94713 | 0.013356 | 85.02894 |
| BE2_UDG | 0.479271 | 1.871172 | 0.026613 | 97.62294 |
| BE3_UDG | 1.666401 | 13.09618 | 0.14136 | 85.09606 |
| BE2_UdgX_On | 0.597649 | 2.235434 | 0.088334 | 97.07858 |
| BE3_UdgX_On | 1.761788 | 19.16713 | 0.155196 | 78.91588 |
| SMUG1 | 5.542508 | 10.38046 | 0.234852 | 83.84218 |

HEK2

| WT Hap1 | Total Edits | A | C | T |
|---|---|---|---|---|
| BE3 | 31.3279752 | 22.43735 | 76.56901 | 0.99364 |
| BE3 | 33.315546 | 17.62629 | 81.56099 | 0.812714 |
| BE3_UdgX | 29.4523771 | 8.24746 | 91.22873 | 0.523809 |
| BE3_UdgX | 29.8367097 | 9.748139 | 88.78137 | 1.47049 |
| BE3_UdgX* | 26.5316462 | 8.642822 | 90.85252 | 0.504655 |
| BE3_REV7 | 14.97105859 | 13.42973 | 86.48106 | 0.089209 |
| BE2_UDG | 2.37705617 | 20.16239 | 78.71804 | 1.119573 |
| BE3_UDG | 14.9039407 | 11.18094 | 87.87059 | 0.948472 |
| BE2_UdgX_On | 2.921416827 | 20.45751 | 76.51882 | 3.023668 |
| BE3_UdgX_On | 21.08411823 | 8.355998 | 90.90792 | 0.73608 |
| SMUG1 | 16.15782057 | 34.30233 | 64.24419 | 1.453488 |

| WT Hap1 | A | C | T | G |
|---|---|---|---|---|
| BE3 | 6.863973 | 5.880153 | 1.025287 | 86.23059 |
| BE3_UdgX | 1.56505 | 5.722939 | 0.61288 | 92.09913 |
| BE3_UdgX* | 1.428268 | 4.662284 | 0.345669 | 93.56378 |
| BE2_UdgX_On | 0.038315 | 0.100759 | 0.023523 | 99.8374 |
| BE3_UdgX_On | 0.04125 | 0.012873 | 0.014673 | 99.9312 |
| BE2_UDG | 0.064905 | 0.103602 | 0.009322 | 99.82217 |
| BE3_UDG | 1.188063 | 2.528846 | 0.34846 | 95.93463 |

RNF2

WT Hap1

| | A | C | T | G |
|---|---|---|---|---|
| BE3 | 6.863973 | 5.880153 | 1.025287 | 86.23059 |
| BE3 | 6.501816 | 5.556838 | 0.980042 | 86.9613 |
| BE3_UdgX | 1.56505 | 5.722939 | 0.61288 | 92.09913 |
| BE3_UdgX | 1.512982 | 4.334513 | 0.317906 | 93.8346 |
| BE3_UdgX | 1.428268 | 4.662284 | 0.345669 | 93.56378 |
| BE3_REV7 | 0.971986 | 1.605961 | 0.14826 | 97.2738 |
| BE2_UDG | 0.064905 | 0.103602 | 0.009322 | 99.82217 |
| BE3_UDG | 1.188063 | 2.528846 | 0.34846 | 95.93463 |
| BE2_UdgX_On | 0.038315 | 0.100759 | 0.023523 | 99.8374 |
| BE3_UdgX_On | 0.04125 | 0.012873 | 0.014673 | 99.9312 |
| SMUG1 | 0.799327 | 0.799327 | 0.12621 | 98.27514 |

RNF2

WT Hap1

| | Total Edits | A | C | T |
|---|---|---|---|---|
| BE3 | 13.769413 | 49.84942 | 42.70446 | 7.44612 |
| BE3 | 13.038696 | 49.86554 | 42.61805 | 7.516411 |
| BE3_UdgX | 7.9008694 | 19.80858 | 72.43429 | 7.757126 |
| BE3_UdgX | 6.1654013 | 24.53988 | 70.30383 | 5.156295 |
| BE3_UdgX | 6.4362206 | 22.1911 | 72.43823 | 5.370677 |
| BE3_REV7 | 2.7262062 | 35.65341 | 58.90827 | 5.438312 |
| BE2_UDG | 0.177828896 | 36.49852 | 58.25915 | 5.242335 |
| BE3_UDG | 4.0653692 | 29.22399 | 62.20458 | 8.571428 |
| BE2_UdgX_On | 0.162597289 | 23.5645 | 61.96868 | 14.46682 |
| BE3_UdgX_On | 0.068796831 | 59.95976 | 18.71227 | 21.32797 |
| SMUG1 | 1.724863273 | 46.34146 | 46.34146 | 7.317073 |

WT Hap1

| | A | C | T | G |
|---|---|---|---|---|
| BE3 | 0.957861 | 85.13409 | 13.29985 | 0.608199 |
| BE3_UdgX | 1.778677 | 86.27834 | 9.689997 | 2.252991 |
| BE3_Udgx* | 1.61547 | 86.04843 | 9.358341 | 2.97776 |
| BE2_UdgX_On | 0.183828 | 99.0089 | 0.540035 | 0.267237 |
| BE3_UdgX_On | 0.10635 | 99.66768 | 0.215432 | 0.010537 |
| BE2_UDG | 0.081416 | 98.62175 | 1.196048 | 0.100783 |
| BE3_UDG | 0.446354 | 95.72025 | 3.352711 | 0.480688 |

FANCF

WT Hap1

| | A | C | T | G |
|---|---|---|---|---|
| BE3 | 0.957861 | 85.13409 | 13.29985 | 0.608199 |
| BE3 | 1.318066 | 78.56728 | 19.15355 | 0.961108 |
| BE3_UdgX | 1.778677 | 86.27834 | 9.689997 | 2.252991 |
| BE3_UdgX | 1.764677 | 87.32044 | 8.332098 | 2.582781 |
| BE3_UdgX | 1.61547 | 86.04843 | 9.689997 | 2.97776 |
| BE3_REV7 | 0.514632 | 93.70418 | 5.31733 | 0.463864 |
| BE2_UDG | 0.081416 | 98.62175 | 1.196048 | 0.100783 |
| BE3_UDG | 0.446354 | 95.72025 | 3.352711 | 0.480688 |
| BE2_UdgXON | 0.183828 | 99.0089 | 0.540035 | 0.267237 |
| BE3_UDGXON | 0.10635 | 99.66768 | 0.215432 | 0.010537 |
| SMUG1 | 0.330974 | 97.17443 | 2.400242 | 0.094351 |

FANCF

WT Hap1

| | Total Edits | A | T | G |
|---|---|---|---|---|
| BE3 | 14.8659096 | 6.443336 | 89.46543 | 4.091234 |
| BE3 | 21.4327257 | 6.149792 | 89.36591 | 4.4843 |
| BE3_UdgX | 13.721665 | 12.96254 | 70.61823 | 16.41922 |
| BE3_UdgX | 12.679556 | 13.9175 | 65.71285 | 20.36965 |
| BE3_UdgX | 13.951571 | 11.57913 | 67.07733 | 21.34355 |
| BE3_REV7 | 6.2958255 | 8.174178 | 84.45803 | 7.367795 |
| BE2_UDG | 1.37824733 | 5.907229 | 86.78036 | 7.31241 |
| BE2_UDG | 4.279753 | 10.42942 | 78.33889 | 11.23169 |
| BE2_UdgXON | 0.991099728 | 18.54785 | 54.48845 | 26.9637 |
| BE3_UDGXON | 0.332319917 | 32.00235 | 64.82678 | 3.170875 |
| SMUG1 | 2.825567162 | 11.71353 | 84.94728 | 3.339192 |

| UDG-/-HAP1 | A | C | T | G |
|---|---|---|---|---|
| BE3 | 54.48563 | 1.099159 | 0.008312 | 44.4069 |
| BE3_UdgX | 61.34017 | 0.562122 | 0.045397 | 38.05231 |
| BE3_UdgX* | 60.98913 | 4.55437 | 0.003002 | 34.4535 |
| BE3_UdgX_On | 24.22648 | 0.224724 | 0.048873 | 75.49992 |
| BE3_UdgX_On | 52.57995 | 0.73715 | 0.056083 | 46.62682 |
| BE2_UDG | 1.126263 | 1.972256 | 0.025385 | 96.8761 |
| BE3_UDG | 3.034692 | 17.10462 | 0.179678 | 79.68102 |

| UDG-/- HAP1 | A | C | T | G |
|---|---|---|---|---|
| BE3 | 54.48563 | 1.099159 | 0.008312 | 44.4069 |
| BE3 | 54.88124 | 0.280479 | 0.037441 | 44.80084 |
| BE3_UdgX | 61.34017 | 0.562122 | 0.045397 | 38.05231 |
| BE3_UDGX | 71.34399 | 1.200882 | 0.015775 | 27.43935 |
| BE3_UDGX | 60.98913 | 4.55437 | 0.003002 | 34.4535 |
| BE3_REV7 | 52.13184 | 1.191155 | 0.028973 | 46.64804 |
| BE2_UDG | 1.126263 | 1.972256 | 0.025385 | 96.8761 |
| BE3_UDG | 3.034692 | 17.10462 | 0.179678 | 79.68102 |
| BE2_UdgX_On | 24.22648 | 0.224724 | 0.048873 | 75.49992 |
| BE3_UdgX_On | 52.57995 | 0.73715 | 0.056083 | 46.62682 |
| SMUG1 | 16.2789 | 0.700013 | 0.052671 | 82.96842 |

| UDG-/- HAP1 | Total Edits | A | C | T |
|---|---|---|---|---|
| BE3 | 55.59310115 | 98.0079 | 1.97715 | 0.014952 |
| BE3 | 55.19916029 | 99.42405 | 0.508121 | 0.06783 |
| BE3_UdgX | 61.94768881 | 99.0193 | 0.907414 | 0.073283 |
| BE3_UDGX | 72.56064713 | 98.32325 | 1.655005 | 0.021741 |
| BE3_UDGX | 65.54650222 | 93.04712 | 6.948304 | 0.00458 |
| BE3_REV7 | 53.35196778 | 97.71306 | 2.232636 | 0.054305 |
| BE2_UDG | 3.12390396 | 36.05306 | 63.13434 | 0.812604 |
| BE3_UDG | 20.3189896 | 14.93525 | 84.18047 | 0.884284 |
| BE2_UdgX_On | 24.50008069 | 98.88328 | 0.917237 | 0.19948 |
| BE3_UdgX_On | 53.37318037 | 98.5138 | 1.381124 | 0.105076 |
| SMUG1 | 17.03158156 | 95.58066 | 4.110088 | 0.309256 |

| UDG-/- HAP1 | A | C | T | G |
|---|---|---|---|---|
| BE3 | 6.074682 | 0.14494 | 0.016881 | 93.7635 |
| BE3_UdgX | 33.90168 | 0.033551 | 0.054252 | 66.01052 |
| BE3_UdgX* | 23.21214 | 0.55525 | 0.050559 | 76.18205 |
| BE2_UdgX_On | 0.510098 | 0.010289 | 0.013813 | 99.4658 |
| BE3_UdgX_On | 16.38801 | 0.073378 | 0.015595 | 83.52302 |
| BE2_UDG | 0.181713 | 0.175531 | 0.013027 | 99.62973 |
| BE3_UDG | 1.925522 | 3.84065 | 0.390487 | 93.84334 |

| UDG-/- HAP1 | A | C | T | G |
|---|---|---|---|---|
| BE3 | 6.074682 | 0.14494 | 0.016881 | 93.7635 |
| BE3 | 17.20021 | 0.014772 | 0.073862 | 82.71116 |
| BE3_UdgX | 33.90168 | 0.033551 | 0.054252 | 66.01052 |
| BE3_UDGX | 29.92735 | 0.262275 | 0.056048 | 69.75433 |
| BE3_UDGX | 23.21214 | 0.55525 | 0.050559 | 76.18205 |
| BE3_REV7 | 16.81834 | 0.510068 | 0.045985 | 82.62561 |
| BE2_UDG | 0.181713 | 0.175531 | 0.013027 | 99.62973 |
| BE3_UDG | 1.925522 | 3.84065 | 0.390487 | 93.84334 |
| BE2_UdgX_On | 0.510098 | 0.010289 | 0.013813 | 99.4658 |
| BE3_UdgX_On | 16.38801 | 0.073378 | 0.015595 | 83.52302 |
| SMUG1 | 2.500624 | 0.048749 | 0.021911 | 97.42872 |

UDG-/-HAP1

| | Total Edits | A | C | T |
|---|---|---|---|---|
| BE3 | 6.23650279 | 97.40526 | 2.324062 | 0.270674 |
| BE3 | 17.28884399 | 99.48733 | 0.085444 | 0.427222 |
| BE3_UdgX | 33.98948321 | 99.74168 | 0.098709 | 0.159615 |
| BE3_UDGX | 30.24567257 | 98.94754 | 0.867148 | 0.185308 |
| BE3_UDGX | 23.81794891 | 97.4565 | 2.331223 | 0.212274 |
| BE3_REV7 | 17.374393 | 96.79958 | 2.935747 | 0.26467 |
| BE2_UDG | 0.37027144 | 49.07573 | 47.40609 | 3.518187 |
| BE3_UDG | 6.1566585 | 31.27544 | 62.38205 | 6.342507 |
| BE2_UdgX_On | 0.534200081 | 95.48813 | 1.926121 | 2.585752 |
| BE3_UdgX_On | 16.47698452 | 99.46002 | 0.445334 | 0.094646 |
| SMUG1 | 2.571284436 | 97.25195 | 1.895891 | 0.85216 |

| UDG-/- HAP1 | A | C | T | G |
|---|---|---|---|---|
| BE3 | 0.081524 | 74.54174 | 25.2736 | 0.10314 |
| BE3_UdgX | 0.007288 | 49.28903 | 50.48537 | 0.218305 |
| BE3_UdgX* | 0.280479 | 48.59955 | 50.86376 | 0.256216 |
| BE2_UdgX_On | 0.068791 | 89.49933 | 10.39908 | 0.032799 |
| BE3_UdgX_On | 0.083133 | 63.6724 | 36.17167 | 0.0728 |
| BE2_UDG | 0.106566 | 98.30479 | 1.362403 | 0.226247 |
| BE3_UDG | 0.717993 | 91.0367 | 7.638342 | 0.606967 |

| UDG-/- HAP1 | A | C | T | G |
|---|---|---|---|---|
| BE3 | 0.081524 | 74.54174 | 25.2736 | 0.10314 |
| BE3 | 0.010804 | 45.91037 | 53.89299 | 0.185833 |
| BE3_UdgX | 0.007288 | 49.28903 | 50.48537 | 0.218305 |
| BE3_UDGX | 0.09751 | 48.31471 | 51.38799 | 0.199794 |
| BE3_UDGX | 0.280479 | 48.59955 | 50.86376 | 0.256216 |
| BE3_REV7 | 0.937192 | 66.39211 | 30.96824 | 1.702469 |
| BE2_UDG | 0.106566 | 98.30479 | 1.362403 | 0.226247 |
| BE3_UDG | 0.717993 | 91.0367 | 7.638342 | 0.606967 |
| BE2_UdgXON | 0.068791 | 89.49933 | 10.39908 | 0.032799 |
| BE3_UDGXON | 0.083133 | 63.6724 | 36.17167 | 0.0728 |
| SMUG1 | 0.08642 | 85.30366 | 14.44968 | 0.160237 |

| UDG-/- HAP1 | Total Edits | A | T | G |
|---|---|---|---|---|
| BE3 | 25.45826365 | 0.320225 | 99.27464 | 0.405133 |
| BE3 | 54.08962767 | 0.019975 | 99.63646 | 0.343566 |
| BE3_UdgX | 50.7109634 | 0.014372 | 99.55514 | 0.430489 |
| BE3_UDGX | 51.68529451 | 0.188662 | 99.42478 | 0.386559 |
| BE3_UDGX | 51.4004551 | 0.545674 | 98.95586 | 0.49847 |
| BE3_REV7 | 33.6079013 | 2.788607 | 92.14571 | 5.065681 |
| BE2_UDG | 1.6952162 | 6.286266 | 80.36751 | 13.34623 |
| BE3_UDG | 8.9633013 | 8.010358 | 85.21795 | 6.771688 |
| BE2_UdgXON | 10.50066614 | 0.655112 | 99.03253 | 0.312353 |
| BE3_UDGXON | 36.32759937 | 0.228842 | 99.57076 | 0.200398 |
| SMUG1 | 14.69633751 | 0.588037 | 98.32164 | 1.090319 |

| REV1-/-_HAP1 | A | C | T | G |
|---|---|---|---|---|
| BE3 | 27.90154 | 38.82184 | 0.21661 | 33.06002 |
| BE3_UdgX | 5.394911 | 62.86946 | 0.220717 | 31.51492 |
| BE2_UDG | 0.583164 | 3.171128 | 0.018236 | 96.22747 |
| BE3_UDG | 3.612539 | 33.5042 | 0.285178 | 62.59809 |
| BE2_UdgX_On | 0.787453 | 2.146845 | 0.072979 | 96.99272 |
| BE3_UdgX_On | 2.845842 | 27.20856 | 0.126609 | 69.81899 |
| SMUG1 | 2.136539 | 12.36191 | 0.104799 | 85.39675 |

| REV1-/- HAP1 | Total Edits | A | C | T |
|---|---|---|---|---|
| BE3 | 66.9399898 | 41.68142 | 57.99499 | 0.323588 |
| BE3_UdgX | 68.4850877 | 7.877497 | 91.80022 | 0.322284 |
| BE2_UDG | 3.77252838 | 15.45818 | 84.05843 | 0.483394 |
| BE3_UDG | 37.4019174 | 9.6587 | 89.57883 | 0.76247 |
| BE2_UdgX_On | 3.007276279 | 26.18491 | 71.38834 | 2.426748 |
| BE3_UdgX_On | 30.18101476 | 9.429247 | 90.151126 | 0.419498 |
| SMUG1 | 14.60324913 | 14.63057 | 84.65179 | 0.717639 |

| REV1-/- HAP1 | A | C | T | G |
|---|---|---|---|---|
| BE3 | 13.37062 | 5.67339 | 1.300502 | 79.6555 |
| BE3_UdgX | 11.30944 | 19.73378 | 1.890332 | 67.06644 |
| BE2_UDG | 0.085476 | 0.118742 | 0.015709 | 99.78008 |
| BE3_UDG | 2.875416 | 7.888452 | 1.180925 | 88.05521 |
| BE2_UdgX_On | 0.066387 | 0.041177 | 0.023698 | 99.86874 |
| BE3_UdgX_On | 1.706863 | 4.37727 | 0.625263 | 93.2906 |
| SMUG1 | 0.741226 | 1.273957 | 0.234637 | 97.75018 |

| REV1-/- HAP1 | Total Edits | A | C | T |
|---|---|---|---|---|
| BE3 | 20.344512 | 65.7210161 | 27.8865868 | 6.39239712 |
| BE3_UdgX | 32.933552 | 34.3401769 | 59.9199868 | 5.73983638 |
| BE2_UDG | 0.21992751 | 38.865538 | 53.9916084 | 7.14285357 |
| BE3_UDG | 11.944793 | 24.0725478 | 66.0409268 | 9.88652545 |
| BE2_UdgX_On | 0.131260725 | 50.5761844 | 31.3700384 | 18.0537772 |
| BE3_UdgX_On | 6.709395472 | 25.4398874 | 65.2408983 | 9.31921428 |
| SMUG1 | 2.24982028 | 32.946027 | 56.6248126 | 10.4291604 |

REV1-/- HAP1

| | A | C | T | G |
|---|---|---|---|---|
| BE3 | 1.850796 | 59.33426 | 38.02208 | 0.792859 |
| BE3_UdgX | 3.486185 | 65.86237 | 22.91265 | 7.738802 |

| | | | | |
|---|---|---|---|---|
| BE2_UDG | 0.222439 | 98.32175 | 1.1797 | 0.276117 |
| BE3_UDG | 0.840939 | 91.43678 | 4.79438 | 2.927905 |
| BE2_UdgXON | 0.208095 | 98.36564 | 1.119386 | 0.306881 |
| BE3_UDGXON | 2.108873 | 82.15436 | 12.85805 | 2.878713 |
| SMUG1 | 0.428121 | 95.46036 | 3.901712 | 0.20981 |

| REV1 -/- HAP1 | Total Edits | A | T | G |
|---|---|---|---|---|
| BE3 | 40.665735 | 4.55124197 | 93.4990601 | 1.94969795 |
| BE3_UdgX | 34.137637 | 10.212145 | 67.1184417 | 22.6694132 |
| BE2_UDG | 1.6782564 | 13.2541786 | 70.2931924 | 16.4526291 |
| BE3_UDG | 8.5632244 | 9.82035926 | 55.9880225 | 34.1916183 |
| BE2_UdgXON | 1.634361336 | 12.732475 | 68.490701 | 18.776824 |
| BE3_UDGXON | 17.84563906 | 11.8173022 | 72.051513 | 16.1311847 |
| SMUG1 | 4.539642813 | 9.43071161 | 85.9475655 | 4.62172285 |

WT HAP1

| | A | C | T | G |
|---|---|---|---|---|
| REV7 | 2.010573 | 12.94713 | 0.013356 | 85.02894 |
| REV1 | 1.406146 | 13.49562 | 0.123125 | 84.97511 |
| Pol Kappa | 7.565693 | 71.44112 | 0.55295 | 20.44024 |
| Pol Eta | 0.642918 | 5.825054 | 0.048496 | 93.48354 |
| Pol Iota | 0.325469 | 2.453959 | 0.028431 | 97.19214 |
| Pol Beta | 4.357398 | 39.83891 | 0.264481 | 55.53921 |
| Pol Delta | 0.756331 | 5.865098 | 0.067151 | 93.31142 |

| WT HAP1 | A | C | T | G |
|---|---|---|---|---|
| REV7 | 0.971986 | 1.605961 | 0.14826 | 97.2738 |
| REV1 | 1.049757 | 2.194175 | 0.415655 | 96.34042 |
| Pol Kappa | 12.50463 | 23.11914 | 4.777591 | 59.59864 |
| Pol Eta | 0.154766 | 0.52873 | 0.080225 | 99.23628 |
| Pol Iota | 0.144902 | 0.361464 | 0.091683 | 99.40196 |
| Pol Beta | 3.958453 | 7.310142 | 1.263852 | 87.46755 |
| Pol Delta | 0.289272 | 0.654239 | 0.108359 | 98.94813 |

| WT HAP1 | A | C | T | G |
|---|---|---|---|---|
| REV7 | 0.514632 | 93.70418 | 5.31733 | 0.463864 |
| REV1 | 0.914949 | 90.84767 | 7.636108 | 0.601268 |
| Pol Kappa | 4.345517 | 53.269 | 39.77689 | 2.608598 |
| Pol Eta | 0.266049 | 97.62926 | 1.852404 | 0.252288 |
| Pol Iota | 0.178977 | 98.23811 | 1.49925 | 0.083658 |
| Pol Beta | 0.001701 | 99.94274 | 0.052159 | 0.003402 |
| Pol Delta | 0.000882 | 99.98706 | 0.010879 | 0.001176 |

MSH2-/- HAP1

| | A | C | T | G |
|---|---|---|---|---|
| BE3 | 7.531235 | 38.16771 | 1.534232 | 52.76683 |
| BE3_UdgX | 2.716642 | 32.76543 | 0.906873 | 63.61105 |
| BE3_UDGX* | 2.13603 | 23.11333 | 0.617898 | 74.13274 |
| BE2_UdgX_On | 0.20333 | 2.012962 | 0.080061 | 97.70365 |
| BE3_UdgX_On | 1.533642 | 18.05043 | 0.530436 | 79.8855 |
| BE3_UDG | 1.36582 | 12.56294 | 0.433865 | 85.63737 |

MSH2-/- HAP1

| | A | C | T | G |
|---|---|---|---|---|
| BE3 | 8.072351 | 9.490587 | 1.359173 | 81.07789 |
| BE3_UdgX | 2.928139 | 15.37726 | 1.290227 | 80.40437 |
| BE3_UDGX* | 1.72001 | 13.87825 | 0.795514 | 83.60623 |
| BE2_UdgX_On | 1.994799 | 0.789305 | 0.110912 | 97.10498 |
| BE3_UdgX_On | 1.403443 | 7.205661 | 0.596091 | 90.7948 |
| BE3_UDG | 0.983205 | 3.27285 | 0.368807 | 95.37514 |

| MSH2-/- HAP1 | A | C | T | G |
|---|---|---|---|---|
| BE3 | 1.865784 | 73.86776 | 22.78622 | 1.480234 |
| BE3_UdgX | 1.202573 | 90.87211 | 5.828738 | 2.096582 |
| BE3_UDGX* | 2.12347 | 85.08395 | 9.365894 | 3.42669 |
| BE2_UdgX_On | 0.167068 | 98.62714 | 0.774116 | 0.431679 |
| BE3_UdgX_On | 1.51146 | 87.87144 | 7.802259 | 2.814836 |
| BE3_UDG | 0.538202 | 94.62867 | 4.22771 | 0.605421 |

CYTOSINE TO GUANINE BASE EDITOR

RELATED APPLICATIONS

This application is a national stage filing under 35 U.S.C. § 371 of international PCT application, PCT/US2018/021878, filed Mar. 9, 2018, which claims priority under 35 U.S.C. § 119(e) to U.S. Provisional Patent Application, U.S. Ser. No. 62/470,175, filed Mar. 10, 2017, each of which is incorporated herein by reference.

REFERENCE TO A SEQUENCE LISTING SUBMITTED AS A TEXT FILE VIA EFS-WEB

This application contains a Sequence Listing which has been submitted in ASCII format via EFS-Web and is hereby incorporated by reference in its entirety. Said ASCII copy, created on Apr. 14, 2021, is named H082470253US01-SUBSEQ-EPG and is 673,227 bytes in size.

BACKGROUND OF INVENTION

Targeted editing of nucleic acid sequences, for example, the targeted cleavage or the targeted introduction of a specific modification into genomic DNA, is a highly promising approach for the study of gene function and also has the potential to provide new therapies for human genetic diseases. Since many genetic diseases in principle can be treated by affecting a specific nucleotide change at a specific location in the genome (for example, a C to G or a G to C change in a specific codon of a gene associated with a disease), the development of a programmable way to achieve such precise gene editing represents both a powerful new research tool, as well as a potential new approach to gene editing-based therapeutics.

BRIEF SUMMARY OF INVENTION

Provided herein are compositions, kits, and methods of modifying a polynucleotide (e.g., DNA), for example, generating a cytosine to guanine mutation in a polynucleotide. As described in greater detail herein, base editing (e.g., C to G editing) was accomplished by removing a nucleobase (e.g., cytosine (C)), thereby generating an abasic site within a nucleic acid sequence. The nucleobase opposite the abasic site (e.g., guanine), is then replaced with a different nucleobase (e.g., cytosine), for example by an endogenous translesion polymerase. Base editing fusion proteins described herein are capable of generating specific mutations (e.g., C to G mutations), within a nucleic acid (e.g., genomic DNA), which can be used, for example, to treat diseases involving nucleic acid mutations, e.g., C to G or G to C mutations.

One example of a C to G base editor includes a fusion protein containing a nucleic acid programmable DNA binding protein (e.g., a Cas9 domain), a uracil DNA glycosylase (UDG) domain, and a cytidine deaminase. Without wishing to be bound by any particular theory, such a base editing fusion protein is capable of binding to a specific nucleic acid sequence (e.g., via the Cas9 domain), deaminating a cytosine within the nucleic acid sequence to a uridine, which can then be excised from the nucleic acid molecule by UDG. The nucleobase opposite the abasic site can then be replaced with another base (e.g., cytosine), for example by an endogenous translesion polymerase. Typically, base repair machinery (e.g., in a cell) replaces a nucleobase opposite an abasic site with a cytosine, although other bases (e.g., adenine, guanine, or thymine) may replace a nucleobase opposite an abasic site. Furthermore, it was found that incorporating a translesion polymerase into the base editor can increase the cytosine incorporation opposite an abasic site. Accordingly, base editors were engineered to incorporate various translesion polymerases to improve base editing efficiency. Translesion polymerases that increase the preference for C integration opposite an abasic site can improve C to G nucleobase editing. It should be appreciated that other translesion polymerases that preferentially integrate non-C nucleobases (e.g., adenine, guanine, and thymine), may be used to generate alternative mutations (e.g., C to A mutations).

As another example, base editing fusion proteins may include a nucleic acid programmable DNA binding protein (e.g., a Cas9 domain), and a base excision enzyme that removes a nucleobase (e.g., a cytosine). Rather than deaminating a cytosine to uridine and excising the uridine using a UDG, as described above, a base editor may include a base excision enzyme that recognizes and removes a nucleobase such as a cytosine or a thymine without first deaminating it. Accordingly, base editors (e.g., C to G base editors) have been engineered by fusing a nucleic acid programmable DNA binding protein (e.g., a Cas9 domain) to a base excision enzyme that removes cytosine or thymine from a nucleic acid molecule. Furthermore, as with the base editor described above, translesion polymerases were incorporated into this base editor to increase the cytosine incorporation opposite an abasic site generated by the base excision enzyme of the base editor. Exemplary base editing proteins and schematic representations outlining base editing strategies can be seen, for example, in FIGS. 1-6, 33-36, 40, and 52.

In some embodiments, the disclosure provides fusion proteins that are capable of base editing. Exemplary base editing fusion proteins include the following. In some embodiments, the fusion protein includes (i) a nucleic acid programmable DNA binding protein (napDNAbp), (ii) a cytidine deaminase domain, and (iii) a uracil binding protein (UBP). In some embodiments, the fusion protein further comprises (iv) a nucleic acid polymerase domain (NAP). As another example, a fusion protein may comprise (i) a nucleic acid programmable DNA binding protein (napDNAbp), (ii) a cytidine deaminase domain, and (iii) a nucleic acid polymerase (NAP) domain. As another example, a fusion protein may comprise (i) a nucleic acid programmable DNA binding protein (napDNAbp), and (ii) a base excision enzyme (BEE). In some embodiments, the fusion protein further includes (iii) a nucleic acid polymerase (NAP) domain. Base editors and methods of using base editors are described below in further detail.

DEFINITIONS

Figure 1:
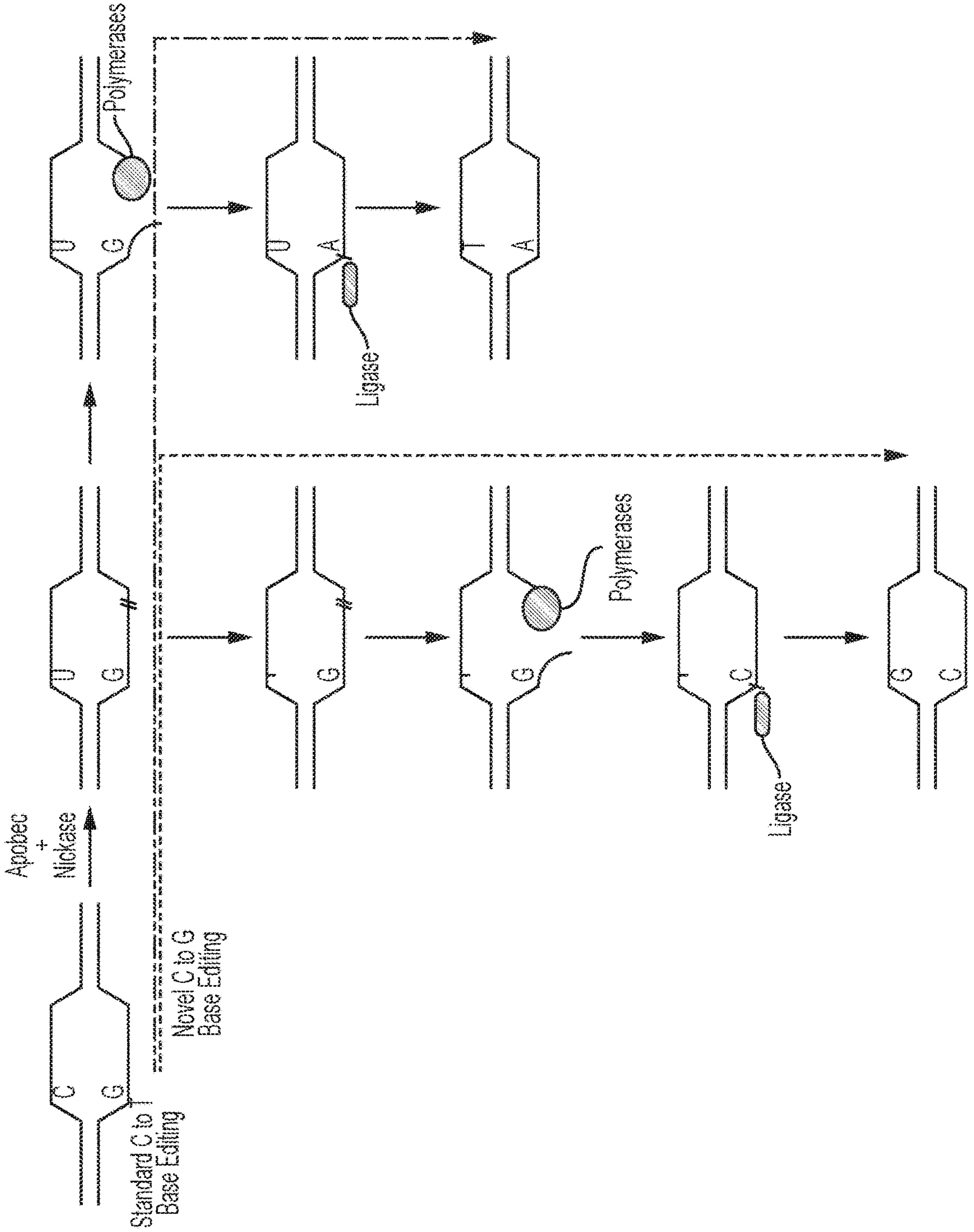
FIG. 1 shows a general schematic illustrating C to T and C to G base editing. Certain DNA polymerases (e.g., translesion polymerases) are known to replace bases opposite abasic sites with G. One strategy to achieve C to G base editing is to induce the creation of an abasic site, then recruit or tether such a polymerase to replace the G opposite the abasic site with a C.

As used herein and in the claims, the singular forms "a," "an," and "the" include the singular and the plural unless the context clearly indicates otherwise. Thus, for example, a reference to "an agent" includes a single agent and a plurality of such agents.

The term "deaminase" or "deaminase domain," as used herein, refers to a protein or enzyme that catalyzes a deamination reaction. In some embodiments, the deaminase or deaminase domain is a cytidine deaminase, catalyzing the hydrolytic deamination of cytidine or deoxycytidine to uridine or deoxyuridine, respectively. In some embodiments, the deaminase or deaminase domain is a cytidine deaminase domain, catalyzing the hydrolytic deamination of cytosine to uracil. In some embodiments, the deaminase or deaminase domain is a naturally-occurring deaminase from an organism, such as a human, chimpanzee, gorilla, monkey, cow, dog, rat, or mouse. In some embodiments, the deaminase or deaminase domain is a variant of a naturally-occurring deaminase from an organism that does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase from an organism.

The term "base editor (BE)," or "nucleobase editor (NBE)" refers to an agent comprising a polypeptide that is capable of making a modification to a base (e.g., A, T, C, G, or U) within a nucleic acid sequence (e.g., DNA or RNA). In some embodiments, the base editor is capable of deaminating a base within a nucleic acid. In some embodiments, the base editor is capable of deaminating a base within a DNA molecule. In some embodiments, the base editor is capable of deaminating a cytosine (C) in DNA. In some embodiments, the base editor is capable of excising a base within a DNA molecule. In some embodiments, the base editor is capable of excising an adenine, guanine, cytosine, thymine or uracil within a nucleic acid (e.g., DNA or RNA) molecule. In some embodiments, the base editor is a protein (e.g., a fusion protein) comprising a nucleic acid programmable DNA binding protein (napDNAbp) fused to a cytidine deaminase. In some embodiments, the base editor is fused to a uracil binding protein (UBP), such as a uracil DNA glycosylase (UDG). In some embodiments, the base editor is fused to a nucleic acid polymerase (NAP) domain. In some embodiments, the NAP domain is a translesion DNA polymerase. In some embodiments, the base editor comprises a napDNAbp, a cytidine deaminase and a UBP (e.g., UDG). In some embodiments, the base editor comprises a napDNAbp, a cytidine deaminase and a nucleic acid polymerase (e.g., a translesion DNA polymerase). In some embodiments, the base editor comprises a napDNAbp, a cytidine deaminase, a UBP (e.g., UDG), and a nucleic acid polymerase (e.g., a translesion DNA polymerase).

In some embodiments, the napDNAbp of the base editor is a Cas9 domain. In some embodiments, the base editor comprises a Cas9 protein fused to a cytidine deaminase. In some embodiments, the base editor comprises a Cas9 nickase (nCas9) fused to a cytidine deaminase. In some embodiments, the Cas9 nickase comprises a D10A mutation and comprises a histidine at residue 840 of SEQ ID NO: 6, or a corresponding mutation in any Cas9 provided herein, such as any one of SEQ ID NOs: 4-26, which renders Cas9 capable of cleaving only one strand of a nucleic acid duplex. In some embodiments, the base editor comprises a nuclease-inactive Cas9 (dCas9) fused to a cytidine deaminase. In some embodiments, the dCas9 domain comprises a D10A and a H840A mutation of SEQ ID NO: 6, or a corresponding mutation in any Cas9 provided herein, such as any one of SEQ ID NOs: 4-26, which inactivates the nuclease activity of the Cas9 protein.

The term "linker," as used herein, refers to a bond (e.g., covalent bond), chemical group, or a molecule linking two molecules or moieties, e.g., two domains of a fusion protein, such as, for example, a nuclease-inactive Cas9 domain and a nucleic acid-editing domain (e.g., an cytidine deaminase). In some embodiments, a linker joins a gRNA binding domain of an RNA-programmable nuclease, including a Cas9 nuclease domain, and the catalytic domain of a nucleic-acid editing protein. In some embodiments, a linker joins a dCas9 and a nucleic-acid editing protein. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated. In some embodiments, a linker comprises the amino acid sequence SGSETPGTSESATPES (SEQ ID NO: 102), which may also be referred to as the XTEN linker. In some embodiments, a linker comprises the amino acid sequence SGGS (SEQ ID NO: 103). In some embodiments, a linker comprises $(SGGS)_n$ (SEQ ID NO: 103), $(GGGS)_n$ (SEQ ID NO: 104), $(GGGGS)_n$ (SEQ ID NO: 105), $(G)_n$ (SEQ ID NO: 121), $(EAAAK)_n$ (SEQ ID NO: 106), $(GGS)_n$(SEQ ID NO: 122), SGSETPGTSESATPES (SEQ ID NO: 102), $(XP)_n$ motif (SEQ ID NO: 123), SGGSSGSETPGTSESATPESSGGS (SEQ ID NO: 107), SGGSSGGSSGSETPGTSESATPESSGGSSGGS (SEQ ID NO: 108), GGSGGSPGSPAGSPTSTEEGTSESATPESGPGTSTEPSEGSAPGSPAGSPTSTEEGTSTE PSEGSAPGTSTEPSEGSAPGTSESATPESGPGSEPATSGGSGGS (SEQ ID NO: 109), SGGSGGSGGS (SEQ ID NO: 120), or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* ($4^{th}$ ed., Cold Spring Harbor Laboratory Press, Cold Spring Harbor, N.Y. (2012)).

The term "uracil binding protein" or "UBP," as used herein, refers to a protein that is capable of binding to uracil. In some embodiments, the uracil binding protein is a uracil modifying enzyme. In some embodiments, the uracil binding protein is a uracil base excision enzyme. In some embodiments, the uracil binding protein is a uracil DNA glycosylase (UDG). In some embodiments, a uracil binding protein binds uracil with an affinity that is at least 1%, 2%, 3%, 5%, 10%, 15%, 20%, 30%, 40%, 50%, 60%, 70%, 80%, 90%, or at least 95% of the affinity that a wild type UDG (e.g., a human UDG) binds to uracil.

The term "base excision enzyme" or "BEE," as used herein, refers to a protein that is capable of removing a base (e.g., A, T, C, G, or U) from a nucleic acid molecule (e.g., DNA or RNA). In some embodiments, a BEE is capable of removing a cytosine from DNA. In some embodiments, a BEE is capable of removing a thymine from DNA. Exemplary BEEs include, without limitation UDG Tyr147Ala, and UDG Asn204Asp as described in Sang et al., "A Unique Uracil-DNA binding protein of the uracil DNA glycosylase superfamily," Nucleic Acids Research, Vol. 43, No. 17 2015; the entire contents of which are hereby incorporated by reference.

The term "nucleic acid polymerase" or "NAP," refers to an enzyme that synthesizes nucleic acid molecules (e.g., DNA and RNA) from nucleotides (e.g., deoxyribonucleotides and ribonucleotides). In some embodiments, the NAP is a DNA polymerase. In some embodiments, the NAP is a translesion polymerase. Translesion polymerases play a role in mutagenesis, for example, by restarting replication forks or filling in gaps that remain in the genome due to the presence of DNA lesions. Exemplary translesion polymerases include, without limitation, Pol Beta, Pol Lambda, Pol Eta, Pol Mu, Pol Iota, Pol Kappa, Pol Alpha, Pol Delta, Pol Gamma, and Pol Nu.

The term "nuclear localization sequence" or "NLS" refers to an amino acid sequence that promotes import of a protein into the cell nucleus, for example, by nuclear transport. Nuclear localization sequences are known in the art and would be apparent to the skilled artisan. In some embodiments, the NLS is a monopartite NLS. In some embodiments, the NLS is a bipartite NLS. Bipartite NLSs are separated by a relatively short spacer sequence (e.g., from 2-20 amino acids, from 5-15 amino acids, or from 8-12 amino acids). For example, NLS sequences are described in Plank et al., international PCT application, PCT/EP2000/011690, filed Nov. 23, 2000, published as WO/2001/038547 on May 31, 2001; and Kethar, K. M. V., et al., "Application of bioinformatics-coupled experimental analysis reveals a new transport-competent nuclear localization signal in the nucleoptotein of Influenza A virus strain" *BMC Cell Biol,* 2008, 9: 22; the contents of each of which are incorporated herein by reference for their disclosure of exemplary nuclear localization sequences. In some embodiments, a NLS comprises the amino acid sequence PKKKRKV (SEQ ID NO: 41), MDSLLMNRRKFLYQFKNVRWAKGRRETYLC (SEQ ID NO: 42), KRTADGSEFESPKKKRKV (SEQ ID NO: 43), KRGINDRNFWRGENGRKTR (SEQ ID NO: 44), KKTGGPIYRRVDGKWRR (SEQ ID NO: 45), RRELILYDKEEIRRIWR (SEQ ID NO: 46), or AVSRKRKA (SEQ ID NO: 47).

The term "nucleic acid programmable DNA binding protein" or "napDNAbp" refers to a protein that associates with a nucleic acid (e.g., DNA or RNA), such as a guide nuclic acid, that guides the napDNAbp to a specific nucleic acid sequence. For example, a Cas9 protein can associate with a guide RNA that guides the Cas9 protein to a specific DNA sequence that has complementary to the guide RNA. In some embodiments, the napDNAbp is a class 2 microbial CRISPR-Cas effector. In some embodiments, the napDNAbp is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), CasX, CasY, Cpf1, C2c1, C2c2, C2C3, and Argonaute. It should be appreciated, however, that nucleic acid programmable DNAbinding proteins also include nucleic acid programmable proteins that bind RNA. For example, the napDNAbp may be associated with a nucleic acid that guides the napDNAbp to an RNA. Other nucleic acid programmable DNA binding proteins are also within the scope of this disclosure, though they may not be specifically listed in this disclosure.

The term "Cas9" or "Cas9 domain" refers to an RNA-guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (mc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. *Science* 337:816-821(2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase.

A nuclease-inactivated Cas9 protein may interchangeably be referred to as a "dCas9" protein (for nuclease-"dead" Cas9). Methods for generating a Cas9 protein (or a fragment thereof) having an inactive DNA cleavage domain are known (See, e.g., Jinek et al., *Science.* 337:816-821(2012); Qi et al., "Repurposing CRISPR as an RNA-Guided Platform for Sequence-Specific Control of Gene Expression" (2013) *Cell.* 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science*. 337:816-821(2012); Qi et al., *Cell*. 28; 152(5):1173-83 (2013)). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or 1300 amino acids in length. In some embodiments, wild type Cas9 corresponds to Cas9 from *Streptococcus pyogenes* (NCBI Reference Sequence: NC_017053.1, SEQ ID NO: 1 (nucleotide); SEQ ID NO: 4 (amino acid)).

(SEQ ID NO: 1)

ATGGATAAGAAATACTCAATAGGCTTAGATATCGGCACAAATAGCGTCGG

ATGGGCGGTGATCACTGATGATTATAAGGTTCCGTCTAAAAAGTTCAAGG

TTCTGGGAAATACAGACCGCCACAGTATCAAAAAAAATCTTATAGGGGCT

CTTTTATTTGGCAGTGGAGAGACAGCGGAAGCGACTCGTCTCAAACGGAC

AGCTCGTAGAAGGTATACACGTCGGAAGAATCGTATTTGTTATCTACAGG

AGATTTTTTCAAATGAGATGGCGAAAGTAGATGATAGTTTCTTTCATCGA

-continued

CTTGAAGAGTCTTTTTTGGTGGAAGAAGACAAGAAGCATGAACGTCATCC

TATTTTTGGAAATATAGTAGATGAAGTTGCTTATCATGAGAAATATCCAA

CTATCTATCATCTGCGAAAAAAATTGGCAGATTCTACTGATAAAGCGGAT

TTGCGCTTAATCTATTTGGCCTTAGCGCATATGATTAAGTTTCGTGGTCA

TTTTTTGATTGAGGGAGATTTAAATCCTGATAATAGTGATGTGGACAAAC

TATTTATCCAGTTGGTACAAATCTACAATCAATTATTTGAAGAAAACCCT

ATTAACGCAAGTAGAGTAGATGCTAAAGCGATTCTTTCTGCACGATTGAG

TAAATCAAGACGATTAGAAAATCTCATTGCTCAGCTCCCCGGTGAGAAGA

GAAATGGCTTGTTTGGGAATCTCATTGCTTTGTCATTGGGATTGACCCCT

AATTTTAAATCAAATTTTGATTTGGCAGAAGATGCTAAATTACAGCTTTC

AAAAGATACTTACGATGATGATTTAGATAATTTATTGGCGCAAATTGGAG

ATCAATATGCTGATTTGTTTTTGGCAGCTAAGAATTTATCAGATGCTATT

TTACTTTCAGATATCCTAAGAGTAAATAGTGAAATAACTAAGGCTCCCCT

ATCAGCTTCAATGATTAAGCGCTACGATGAACATCATCAAGACTTGACTC

TTTTAAAAGCTTTAGTTCGACAACAACTTCCAGAAAAGTATAAAGAAATC

TTTTTTGATCAATCAAAAAACGGATATGCAGGTTATATTGATGGGGGAGC

TAGCCAAGAAGAATTTTATAAATTTATCAAACCAATTTTAGAAAAAATGG

ATGGTACTGAGGAATTATTGGTGAAACTAAATCGTGAAGATTTGCTGCGC

AAGCAACGGACCTTTGACAACGGCTCTATTCCCCATCAAATTCACTTGGG

TGAGCTGCATGCTATTTTGAGAAGACAAGAAGACTTTTATCCATTTTTAA

AAGACAATCGTGAGAAGATTGAAAAAATCTTGACTTTTCGAATTCCTTAT

TATGTTGGTCCATTGGCGCGTGGCAATAGTCGTTTTGCATGGATGACTCG

GAAGTCTGAAGAAACAATTACCCCATGGAATTTTGAAGAAGTTGTCGATA

AAGGTGCTTCAGCTCAATCATTTATTGAACGCATGACAAACTTTGATAAA

AATCTTCCAAATGAAAAAGTACTACCAAAACATAGTTTGCTTTATGAGTA

TTTTACGGTTTATAACGAATTGACAAAGGTCAAATATGTTACTGAGGGAA

TGCGAAAACCAGCATTTCTTTCAGGTGAACAGAAGAAAGCCATTGTTGAT

TTACTCTTCAAAACAAATCGAAAAGTAACCGTTAAGCAATTAAAAGAAGA

TTATTTCAAAAAAATAGAATGTTTTGATAGTGTTGAAATTTCAGGAGTTG

AAGATAGATTTAATGCTTCATTAGGCGCCTACCATGATTTGCTAAAAATT

ATTAAAGATAAAGATTTTTTGGATAATGAAGAAAATGAAGATATCTTAGA

GGATATTGTTTTAACATTGACCTTATTTGAAGATAGGGGGATGATTGAGG

AAAGACTTAAAACATATGCTCACCTCTTTGATGATAAGGTGATGAAACAG

CTTAAACGTCGCCGTTATACTGGTTGGGGACGTTTGTCTCGAAAATTGAT

TAATGGTATTAGGGATAAGCAATCTGGCAAAACAATATTAGATTTTTTGA

AATCAGATGGTTTTGCCAATCGCAATTTTATGCAGCTGATCCATGATGAT

AGTTTGACATTTAAAGAAGATATTCAAAAAGCACAGGTGTCTGGACAAGG

CCATAGTTTACATGAACAGATTGCTAACTTAGCTGGCAGTCCTGCTATTA

AAAAAGGTATTTTACAGACTGTAAAAATTGTTGATGAACTGGTCAAAGTA

ATGGGGCATAAGCCAGAAAATATCGTTATTGAAATGGCACGTGAAAATCA

GACAACTCAAAAGGGCCAGAAAAATTCGCGAGAGCGTATGAAACGAATCG

-continued

AAGAAGGTATCAAAGAATTAGGAAGTCAGATTCTTAAAGAGCATCCTGTT
GAAAATACTCAATTGCAAAATGAAAAGCTCTATCTCTATTATCTACAAAA
TGGAAGAGACATGTATGTGGACCAAGAATTAGATATTAATCGTTTAAGTG
ATTATGATGTCGATCACATTGTTCCACAAAGTTTCATTAAAGACGATTCA
ATAGACAATAAGGTACTAACGCGTTCTGATAAAAATCGTGGTAAATCGGA
TAACGTTCCAAGTGAAGAAGTAGTCAAAAAGATGAAAAACTATTGGAGAC
AACTTCTAAACGCCAAGTTAATCACTCAACGTAAGTTTGATAATTTAACG
AAAGCTGAACGTGGAGGTTTGAGTGAACTTGATAAAGCTGGTTTTATCAA
ACGCCAATTGGTTGAAACTCGCCAAATCACTAAGCATGTGGCACAAATTT
TGGATAGTCGCATGAATACTAAATACGATGAAAATGATAAACTTATTCGA
GAGGTTAAAGTGATTACCTTAAAATCTAAATTAGTTTCTGACTTCCGAAA
AGATTTCCAATTCTATAAAGTACGTGAGATTAACAATTACCATCATGCCC
ATGATGCGTATCTAAATGCCGTCGTTGGAACTGCTTTGATTAAGAAATAT
CCAAAACTTGAATCGGAGTTTGTCTATGGTGATTATAAAGTTTATGATGT
TCGTAAAATGATTGCTAAGTCTGAGCAAGAAATAGGCAAAGCAACCGCAA
AATATTTCTTTTACTCTAATATCATGAACTTCTTCAAAACAGAAATTACA
CTTGCAAATGGAGAGATTCGCAAACGCCCTCTAATCGAAACTAATGGGGA
AACTGGAGAAATTGTCTGGGATAAAGGGCGAGATTTTGCCACAGTGCGCA
AAGTATTGTCCATGCCCCAAGTCAATATTGTCAAGAAAACAGAAGTACAG
ACAGGCGGATTCTCCAAGGAGTCAATTTTACCAAAAAGAAATTCGGACAA
GCTTATTGCTCGTAAAAAAGACTGGGATCCAAAAAAATATGGTGGTTTTG
ATAGTCCAACGGTAGCTTATTCAGTCCTAGTGGTTGCTAAGGTGGAAAAA
GGGAAATCGAAGAAGTTAAAATCCGTTAAAGAGTTACTAGGGATCACAAT
TATGGAAAGAAGTTCCTTTGAAAAAAATCCGATTGACTTTTTAGAAGCTA
AAGGATATAAGGAAGTTAAAAAAGACTTAATCATTAAACTACCTAAATAT
AGTCTTTTTGAGTTAGAAAACGGTCGTAAACGGATGCTGGCTAGTGCCGG
AGAATTACAAAAAGGAAATGAGCTGGCTCTGCCAAGCAAATATGTGAATT
TTTTATATTTAGCTAGTCATTATGAAAAGTTGAAGGGTAGTCCAGAAGAT
AACGAACAAAAACAATTGTTTGTGGAGCAGCATAAGCATTATTTAGATGA
GATTATTGAGCAAATCAGTGAATTTTCTAAGCGTGTTATTTTAGCAGATG
CCAATTTAGATAAAGTTCTTAGTGCATATAACAAACATAGAGACAAACCA
ATACGTGAACAAGCAGAAAATATTATTCATTTATTTACGTTGACGAATCT
TGGAGCTCCCGCTGCTTTTAAATATTTTGATACAACAATTGATCGTAAAC
GATATACGTCTACAAAAGAAGTTTTAGATGCCACTCTTATCCATCAATCC
ATCACTGGTCTTTATGAAACACGCATTGATTTGAGTCAGCTAGGAGGTGA
CTGA (SEQ ID NO: 4)

MDKKYSIGLDIGTNSVGWAVITDDYKVPSKKFKVLGNTDRHSIKKNLIGA
LLFGSGETAEATRLKRTARRRYTRRKNRICYLQEIFSNEMAKVDDSFFHR
LEESFLVEEDKKHERHPIFGNIVDEVAYHEKYPTIYHLRKKLADSTDKAD
LRLIYLALAHMIKFRGHFLIEGDLNPDNSDVDKLFIQLVQIYNQLFEENP
INASRVDAKAILSARLSKSRRLENLIAQLPGEKRNGLFGNLIALSLGLTP
NFKSNFDLAEDAKLQLSKDTYDDDLDNLLAQIGDQYADLFLAAKNLSDAI
LLSDILRVNSEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGAYHDLLKI
IKDKDFLDNEENEDILEDIVLTLTLFEDRGMIEERLKTYAHLFDDKVMKQ
LKRRRYTGWGRLSRKLINGIRDKQSGKTILDFLKSDGFANRNFMQLIHDD
SLTFKEDIQKAQVSGQGHSLHEQIANLAGSPAIKKGILQTVKIVDELVKV
MGHKPENIVIEMARENQTTQKGQKNSRERMKRIEEGIKELGSQILKEHPV
ENTQLQNEKLYLYYLQNGRDMYVDQELDINRLSDYDVDHIVPQSFIKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFDSPTVAYSVLVVAKVEK
GKSKKLKSVKELLGITIMERSSFEKNPIDFLEAKGYKEVKKDLIIKLPKY
SLFELENGRKRMLASAGELQKGNELALPSKYVNFLYLASHYEKLKGSPED
NEQKQLFVEQHKHYLDEIIEQISEFSKRVILADANLDKVLSAYNKHRDKP
IREQAENIIHLFTLTNLGAPAAFKYFDTTIDRKRYTSTKEVLDATLIHQS
ITGLYETRIDLSQLGGD (single underline: HNH domain; double underline: RuvC domain)

(single underline: HNH domain; double underline: RuvC domain)

In some embodiments, wild type Cas9 corresponds to, or comprises SEQ ID NO: 2 (nucleotide) and/or SEQ ID NO: 5 (amino acid):

(SEQ ID NO: 2)

ATGGATAAAAAGTATTCTATTGGTTTAGACATCGGCACTAATTCCGTTG
GATGGGCTGTCATAACCGATGAATACAAAGTACCTTCAAAGAAATTTAA
GGTGTTGGGGAACACAGACCGTCATTCGATTAAAAAGAATCTTATCGGT
GCCCTCCTATTCGATAGTGGCGAAACGGCAGAGGCGACTCGCCTGAAAC
GAACCGCTCGGAGAAGGTATACACGTCGCAAGAACCGAATATGTTACTT
ACAAGAAATTTTTAGCAATGAGATGGCCAAAGTTGACGATTCTTTCTTT
CACCGTTTGGAAGAGTCCTTCCTTGTCGAAGAGGACAAGAAACATGAAC
GGCACCCCATCTTTGGAAACATAGTAGATGAGGTGGCATATCATGAAAA
GTACCCAACGATTTATCACCTCAGAAAAAAGCTAGTTGACTCAACTGAT

-continued

AAAGCGGACCTGAGGTTAATCTACTTGGCTCTTGCCCATATGATAAAGT

TCCGTGGGCACTTTCTCATTGAGGGTGATCTAAATCCGGACAACTCGGA

TGTCGACAAACTGTTCATCCAGTTAGTACAAACCTATAATCAGTTGTTT

GAAGAGAACCCTATAAATGCAAGTGGCGTGGATGCGAAGGCTATTCTTA

GCGCCCGCCTCTCTAAATCCCGACGGCTAGAAAACCTGATCGCACAATT

ACCCGGAGAGAAGAAAAATGGGTTGTTCGGTAACCTTATAGCGCTCTCA

CTAGGCCTGACACCAAATTTTAAGTCGAACTTCGACTTAGCTGAAGATG

CCAAATTGCAGCTTAGTAAGGACACGTACGATGACGATCTCGACAATCT

ACTGGCACAAATTGGAGATCAGTATGCGGACTTATTTTTGGCTGCCAAA

AACCTTAGCGATGCAATCCTCCTATCTGACATACTGAGAGTTAATACTG

AGATTACCAAGGCGCCGTTATCCGCTTCAATGATCAAAAGGTACGATGA

ACATCACCAAGACTTGACACTTCTCAAGGCCCTAGTCCGTCAGCAACTG

CCTGAGAAATATAAGGAAATATTCTTTGATCAGTCGAAAAACGGGTACG

CAGGTTATATTGACGGCGGAGCGAGTCAAGAGGAATTCTACAAGTTTAT

CAAACCCATATTAGAGAAGATGGATGGGACGGAAGAGTTGCTTGTAAAA

CTCAATCGCGAAGATCTACTGCGAAAGCAGCGGACTTTCGACAACGGTA

GCATTCCACATCAAATCCACTTAGGCGAATTGCATGCTATACTTAGAAG

GCAGGAGGATTTTTATCCGTTCCTCAAAGACAATCGTGAAAAGATTGAG

AAAATCCTAACCTTTCGCATACCTTACTATGTGGGACCCCTGGCCCGAG

GGAACTCTCGGTTCGCATGGATGACAAGAAAGTCCGAAGAAACGATTAC

TCCATGGAATTTTGAGGAAGTTGTCGATAAAGGTGCGTCAGCTCAATCG

TTCATCGAGAGGATGACCAACTTTGACAAGAATTTACCGAACGAAAAAG

TATTGCCTAAGCACAGTTTACTTTACGAGTATTTCACAGTGTACAATGA

ACTCACGAAAGTTAAGTATGTCACTGAGGGCATGCGTAAACCCGCCTTT

CTAAGCGGAGAACAGAAGAAAGCAATAGTAGATCTGTTATTCAAGACCA

ACCGCAAAGTGACAGTTAAGCAATTGAAAGAGGACTACTTTAAGAAAAT

TGAATGCTTCGATTCTGTCGAGATCTCCGGGGTAGAAGATCGATTTAAT

GCGTCACTTGGTACGTATCATGACCTCCTAAAGATAATTAAAGATAAGG

ACTTCCTGGATAACGAAGAGAATGAAGATATCTTAGAAGATATAGTGTT

GACTCTTACCCTCTTTGAAGATCGGGAAATGATTGAGGAAAGACTAAAA

ACATACGCTCACCTGTTCGACGATAAGGTTATGAAACAGTTAAAGAGGC

GTCGCTATACGGGCTGGGGACGATTGTCGCGGAAACTTATCAACGGGAT

AAGAGACAAGCAAAGTGGTAAAACTATTCTCGATTTTCTAAAGAGCGAC

GGCTTCGCCAATAGGAACTTTATGCAGCTGATCCATGATGACTCTTTAA

CCTTCAAAGAGGATATACAAAAGGCACAGGTTTCCGGACAAGGGGACTC

ATTGCACGAACATATTGCGAATCTTGCTGGTTCGCCAGCCATCAAAAAG

GGCATACTCCAGACAGTCAAAGTAGTGGATGAGCTAGTTAAGGTCATGG

GACGTCACAAACCGGAAAACATTGTAATCGAGATGGCACGCGAAAATCA

AACGACTCAGAAGGGGCAAAAAAACAGTCGAGAGCGGATGAAGAGAATA

GAAGAGGGTATTAAAGAACTGGGCAGCCAGATCTTAAAGGAGCATCCTG

TGGAAAATACCCAATTGCAGAACGAGAAACTTTACCTCTATTACCTACA

-continued

AAATGGAAGGGACATGTATGTTGATCAGGAACTGGACATAAACCGTTTA

TCTGATTACGACGTCGATCACATTGTACCCCAATCCTTTTTGAAGGACG

ATTCAATCGACAATAAAGTGCTTACACGCTCGGATAAGAACCGAGGGAA

AAGTGACAATGTTCCAAGCGAGGAAGTCGTAAAGAAAATGAAGAACTAT

TGGCGGCAGCTCCTAAATGCGAAACTGATAACGCAAAGAAAGTTCGATA

ACTTAACTAAAGCTGAGAGGGGTGGCTTGTCTGAACTTGACAAGGCCGG

ATTTATTAAACGTCAGCTCGTGGAAACCCGCCAAATCACAAAGCATGTT

GCACAGATACTAGATTCCCGAATGAATACGAAATACGACGAGAACGATA

AGCTGATTCGGGAAGTCAAAGTAATCACTTTAAAGTCAAAATTGGTGTC

GGACTTCAGAAAGGATTTTCAATTCTATAAAGTTAGGGAGATAAATAAC

TACCACCATGCGCACGACGCTTATCTTAATGCCGTCGTAGGGACCGCAC

TCATTAAGAAATACCCGAAGCTAGAAAGTGAGTTTGTGTATGGTGATTA

CAAAGTTTATGACGTCCGTAAGATGATCGCGAAAAGCGAACAGGAGATA

GGCAAGGCTACAGCCAAATACTTCTTTTATTCTAACATTATGAATTTCT

TTAAGACGGAAATCACTCTGGCAAACGGAGAGATACGCAAACGACCTTT

AATTGAAACCAATGGGGAGACAGGTGAAATCGTATGGGATAAGGGCCGG

GACTTCGCGACGGTGAGAAAAGTTTTGTCCATGCCCCAAGTCAACATAG

TAAAGAAAACTGAGGTGCAGACCGGAGGGTTTTCAAAGGAATCGATTCT

TCCAAAAAGGAATAGTGATAAGCTCATCGCTCGTAAAAAGGACTGGGAC

CCGAAAAAGTACGGTGGCTTCGATAGCCCTACAGTTGCCTATTCTGTCC

TAGTAGTGGCAAAAGTTGAGAAGGGAAAATCCAAGAAACTGAAGTCAGT

CAAAGAATTATTGGGGATAACGATTATGGAGCGCTCGTCTTTTGAAAAG

AACCCCATCGACTTCCTTGAGGCGAAAGGTTACAAGGAAGTAAAAAAGG

ATCTCATAATTAAACTACCAAAGTATAGTCTGTTTGAGTTAGAAAATGG

CCGAAAACGGATGTTGGCTAGCGCCGGAGAGCTTCAAAAGGGGAACGAA

CTCGCACTACCGTCTAAATACGTGAATTTCCTGTATTTAGCGTCCCATT

ACGAGAAGTTGAAAGGTTCACCTGAAGATAACGAACAGAAGCAACTTTT

TGTTGAGCAGCACAAACATTATCTCGACGAAATCATAGAGCAAATTTCG

GAATTCAGTAAGAGAGTCATCCTAGCTGATGCCAATCTGGACAAAGTAT

TAAGCGCATACAACAAGCACAGGGATAAACCCATACGTGAGCAGGCGGA

AAATATTATCCATTTGTTTACTCTTACCAACCTCGGCGCTCCAGCCGCA

TTCAAGTATTTTGACACAACGATAGATCGCAAACGATACACTTCTACCA

AGGAGGTGCTAGACGCGACACTGATTCACCAATCCATCACGGGATTATA

TGAAACTCGGATAGATTTGTCACAGCTTGGGGGTGACGGATCCCCCAAG

AAGAAGAGGAAAGTCTCGAGCGACTACAAAGACCATGACGGTGATTATA

AAGATCATGACATCGATTACAAGGATGACGATGACAAGGCTGCAGGA (SEQ ID NO: 5)

MDKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

-continued

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD (single underline: HNH domain; double underline: RuvC domain)

In some embodiments, wild type Cas9 corresponds to Cas9 from *Streptococcus pyogenes* (NCBI Reference Sequence: NC_002737.2, SEQ ID NO: 3 (nucleotide); and Uniport Reference Sequence: Q99ZW2, SEQ ID NO: 6 (amino acid).

(SEQ ID NO: 3)

ATGGATAAGAAATACTCAATAGGCTTAGATATCGGCACAAATAGCGTCG

GATGGGCGGTGATCACTGATGAATATAAGGTTCCGTCTAAAAAGTTCAA

GGTTCTGGGAAATACAGACCGCCACAGTATCAAAAAAAATCTTATAGGG

GCTCTTTTATTTGACAGTGGAGAGACAGCGGAAGCGACTCGTCTCAAAC

GGACAGCTCGTAGAAGGTATACACGTCGGAAGAATCGTATTTGTTATCT

ACAGGAGATTTTTTCAAATGAGATGGCGAAAGTAGATGATAGTTTCTTT

CATCGACTTGAAGAGTCTTTTTTGGTGGAAGAAGACAAGAAGCATGAAC

GTCATCCTATTTTTGGAAATATAGTAGATGAAGTTGCTTATCATGAGAA

ATATCCAACTATCTATCATCTGCGAAAAAAATTGGTAGATTCTACTGAT

-continued

AAAGCGGATTTGCGCTTAATCTATTTGGCCTTAGCGCATATGATTAAGT

TTCGTGGTCATTTTTTGATTGAGGGAGATTTAAATCCTGATAATAGTGA

TGTGGACAAACTATTTATCCAGTTGGTACAAACCTACAATCAATTATTT

GAAGAAAACCCTATTAACGCAAGTGGAGTAGATGCTAAAGCGATTCTTT

CTGCACGATTGAGTAAATCAAGACGATTAGAAAATCTCATTGCTCAGCT

CCCCGGTGAGAAGAAAAATGGCTTATTTGGGAATCTCATTGCTTTGTCA

TTGGGTTTGACCCCTAATTTTAAATCAAATTTTGATTTGGCAGAAGATG

CTAAATTACAGCTTTCAAAAGATACTTACGATGATGATTTAGATAATTT

ATTGGCGCAAATTGGAGATCAATATGCTGATTTGTTTTTGGCAGCTAAG

AATTTATCAGATGCTATTTTACTTTCAGATATCCTAAGAGTAAATACTG

AAATAACTAAGGCTCCCCTATCAGCTTCAATGATTAAACGCTACGATGA

ACATCATCAAGACTTGACTCTTTTAAAAGCTTTAGTTCGACAACAACTT

CCAGAAAAGTATAAAGAAATCTTTTTTGATCAATCAAAAAACGGATATG

CAGGTTATATTGATGGGGGAGCTAGCCAAGAAGAATTTTATAAATTTAT

CAAACCAATTTTAGAAAAAATGGATGGTACTGAGGAATTATTGGTGAAA

CTAAATCGTGAAGATTTGCTGCGCAAGCAACGGACCTTTGACAACGGCT

CTATTCCCCATCAAATTCACTTGGGTGAGCTGCATGCTATTTTGAGAAG

ACAAGAAGACTTTTATCCATTTTTAAAAGACAATCGTGAGAAGATTGAA

AAAATCTTGACTTTTCGAATTCCTTATTATGTTGGTCCATTGGCGCGTG

GCAATAGTCGTTTTGCATGGATGACTCGGAAGTCTGAAGAAACAATTAC

CCCATGGAATTTTGAAGAAGTTGTCGATAAAGGTGCTTCAGCTCAATCA

TTTATTGAACGCATGACAAACTTTGATAAAAATCTTCCAAATGAAAAAG

TACTACCAAAACATAGTTTGCTTTATGAGTATTTTACGGTTTATAACGA

ATTGACAAAGGTCAAATATGTTACTGAAGGAATGCGAAAACCAGCATTT

CTTTCAGGTGAACAGAAGAAAGCCATTGTTGATTTACTCTTCAAAACAA

ATCGAAAAGTAACCGTTAAGCAATTAAAAGAAGATTATTTCAAAAAAAT

AGAATGTTTTGATAGTGTTGAAATTTCAGGAGTTGAAGATAGATTTAAT

GCTTCATTAGGTACCTACCATGATTTGCTAAAAATTATTAAAGATAAAG

ATTTTTTGGATAATGAAGAAAATGAAGATATCTTAGAGGATATTGTTTT

AACATTGACCTTATTTGAAGATAGGGAGATGATTGAGGAAAGACTTAAA

ACATATGCTCACCTCTTTGATGATAAGGTGATGAAACAGCTTAAACGTC

GCCGTTATACTGGTTGGGGACGTTTGTCTCGAAAATTGATTAATGGTAT

TAGGGATAAGCAATCTGGCAAAACAATATTAGATTTTTTGAAATCAGAT

GGTTTTGCCAATCGCAATTTTATGCAGCTGATCCATGATGATAGTTTGA

CATTTAAAGAAGACATTCAAAAAGCACAAGTGTCTGGACAAGGCGATAG

TTTACATGAACATATTGCAAATTTAGCTGGTAGCCCTGCTATTAAAAAA

GGTATTTTACAGACTGTAAAAGTTGTTGATGAATTGGTCAAAGTAATGG

GGCGGCATAAGCCAGAAAATATCGTTATTGAAATGGCACGTGAAAATCA

GACAACTCAAAAGGGCCAGAAAAATTCGCGAGAGCGTATGAAACGAATC

GAAGAAGGTATCAAAGAATTAGGAAGTCAGATTCTTAAAGAGCATCCTG

TTGAAAATACTCAATTGCAAAATGAAAAGCTCTATCTCTATTATCTCCA

-continued

AAATGGAAGAGACATGTATGTGGACCAAGAATTAGATATTAATCGTTTA

AGTGATTATGATGTCGATCACATTGTTCCACAAAGTTTCCTTAAAGACG

ATTCAATAGACAATAAGGTCTTAACGCGTTCTGATAAAAATCGTGGTAA

ATCGGATAACGTTCCAAGTGAAGAAGTAGTCAAAAAGATGAAAAACTAT

TGGAGACAACTTCTAAACGCCAAGTTAATCACTCAACGTAAGTTTGATA

ATTTAACGAAAGCTGAACGTGGAGGTTTGAGTGAACTTGATAAAGCTGG

TTTTATCAAACGCCAATTGGTTGAAACTCGCCAAATCACTAAGCATGTG

GCACAAATTTTGGATAGTCGCATGAATACTAAATACGATGAAAATGATA

AACTTATTCGAGAGGTTAAAGTGATTACCTTAAAATCTAAATTAGTTTC

TGACTTCCGAAAAGATTTCCAATTCTATAAAGTACGTGAGATTAACAAT

TACCATCATGCCCATGATGCGTATCTAAATGCCGTCGTTGGAACTGCTT

TGATTAAGAAATATCCAAAACTTGAATCGGAGTTTGTCTATGGTGATTA

TAAAGTTTATGATGTTCGTAAAATGATTGCTAAGTCTGAGCAAGAAATA

GGCAAAGCAACCGCAAAATATTTCTTTTACTCTAATATCATGAACTTCT

TCAAAACAGAAATTACACTTGCAAATGGAGAGATTCGCAAACGCCCTCT

AATCGAAACTAATGGGGAAACTGGAGAAATTGTCTGGGATAAAGGGCGA

GATTTTGCCACAGTGCGCAAAGTATTGTCCATGCCCCAAGTCAATATTG

TCAAGAAAACAGAAGTACAGACAGGCGGATTCTCCAAGGAGTCAATTTT

ACCAAAAAGAAATTCGGACAAGCTTATTGCTCGTAAAAAAGACTGGGAT

CCAAAAAAATATGGTGGTTTTGATAGTCCAACGGTAGCTTATTCAGTCC

TAGTGGTTGCTAAGGTGGAAAAAGGGAAATCGAAGAAGTTAAAATCCGT

TAAAGAGTTACTAGGGATCACAATTATGGAAAGAAGTTCCTTTGAAAAA

AATCCGATTGACTTTTTAGAAGCTAAAGGATATAAGGAAGTTAAAAAAG

ACTTAATCATTAAACTACCTAAATATAGTCTTTTTGAGTTAGAAAACGG

TCGTAAACGGATGCTGGCTAGTGCCGGAGAATTACAAAAAGGAAATGAG

CTGGCTCTGCCAAGCAAATATGTGAATTTTTTATATTTAGCTAGTCATT

ATGAAAAGTTGAAGGGTAGTCCAGAAGATAACGAACAAAAACAATTGTT

TGTGGAGCAGCATAAGCATTATTTAGATGAGATTATTGAGCAAATCAGT

GAATTTTCTAAGCGTGTTATTTTAGCAGATGCCAATTTAGATAAAGTTC

TTAGTGCATATAACAAACATAGAGACAAACCAATACGTGAACAAGCAGA

AAATATTATTCATTTATTTACGTTGACGAATCTTGGAGCTCCCGCTGCT

TTTAAATATTTTGATACAACAATTGATCGTAAACGATATACGTCTACAA

AAGAAGTTTTAGATGCCACTCTTATCCATCAATCCATCACTGGTCTTTA

TGAAACACGCATTGATTTGAGTCAGCTAGGAGGTGACTGA (SEQ ID NO: 6)

MDKKYSIGLDIGTNSVGWAVITDEYKVPSKKFKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

-continued

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD (single underline: HNH domain; double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisl* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria. meningitidis* (NCBI Ref: YP_002342100.1) or to a Cas9 from any other organism.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation of SEQ ID NO: 6 or corresponding mutations in another Cas9. In some embodiments, the dCas9 comprises the amino acid sequence of SEQ ID NO: 7 dCas9 (D10A and H840A):

(SEQ ID NO: 7)

MDKKYSIGLAIGTNSVGWAVITDEYKVPSKKFKVLGNTDRHSIKKNLIG
ALLFDSGETAEATRLKRTARRRYTRRKNRICYLQEIFSNEMAKVDDSFF
HRLEESFLVEEDKKHERHPIFGNIVDEVAYHEKYPTIYHLRKKLVDSTD
KADLRLIYLALAHMIKFRGHFLIEGDLNPDNSDVDKLFIQLVQTYNQLF
EENPINASGVDAKAILSARLSKSRRLENLIAQLPGEKKNGLFGNLIALS
LGLTPNFKSNFDLAEDAKLQLSKDTYDDDLDNLLAQIGDQYADLFLAAK
NLSDAILLSDILRVNTEITKAPLSASMIKRYDEHHQDLTLLKALVRQQL
PEKYKEIFFDQSKNGYAGYIDGGASQEEFYKFIKPILEKMDGTEELLVK
LNREDLLRKQRTFDNGSIPHQIHLGELHAILRRQEDFYPFLKDNREKIE
KILTFRIPYYVGPLARGNSRFAWMTRKSEETITPWNFEEVVDKGASAQS
FIERMTNFDKNLPNEKVLPKHSLLYEYFTVYNELTKVKYVTEGMRKPAF
LSGEQKKAIVDLLFKTNRKVTVKQLKEDYFKKIECFDSVEISGVEDRFN
ASLGTYHDLLKIIKDKDFLDNEENEDILEDIVLTLTLFEDREMIEERLK
TYAHLFDDKVMKQLKRRRYTGWGRLSRKLINGIRDKQSGKTILDFLKSD
GFANRNFMQLIHDDSLTFKEDIQKAQVSGQGDSLHEHIANLAGSPAIKK
GILQTVKVVDELVKVMGRHKPENIVIEMARENQTTQKGQKNSRERMKRI
EEGIKELGSQILKEHPVENTQLQNEKLYLYYLQNGRDMYVDQELDINRL
SDYDVDAIVPQSFLKDDSIDNKVLTRSDKNRGKSDNVPSEEVVKKMKNY
WRQLLNAKLITQRKFDNLTKAERGGLSELDKAGFIKRQLVETRQITKHV
AQILDSRMNTKYDENDKLIREVKVITLKSKLVSDFRKDFQFYKVREINN
YHHAHDAYLNAVVGTALIKKYPKLESEFVYGDYKVYDVRKMIAKSEQEI
GKATAKYFFYSNIMNFFKTEITLANGEIRKRPLIETNGETGEIVWDKGR
DFATVRKVLSMPQVNIVKKTEVQTGGFSKESILPKRNSDKLIARKKDWD
PKKYGGFDSPTVAYSVLVVAKVEKGKSKKLKSVKELLGITIMERSSFEK
NPIDFLEAKGYKEVKKDLIIKLPKYSLFELENGRKRMLASAGELQKGNE
LALPSKYVNFLYLASHYEKLKGSPEDNEQKQLFVEQHKHYLDEIIEQIS
EFSKRVILADANLDKVLSAYNKHRDKPIREQAENIIHLFTLTNLGAPAA
FKYFDTTIDRKRYTSTKEVLDATLIHQSITGLYETRIDLSQLGGD (single underline: HNH domain; double underline: RuvC domain).

In some embodiments, the Cas9 domain comprises a D10A mutation, while the residue at position 840 remains a histidine in the amino acid sequence provided in SEQ ID NO: 6, or at corresponding positions in another Cas9, such as a Cas9 set forth in any of the amino acid sequences provided in SEQ ID NOs: 4-26. Without wishing to be bound by any particular theory, the presence of the catalytic residue H840 maintains the activity of the Cas9 to cleave the non-edited (e.g., non-deaminated) strand containing a T opposite the targeted A. Restoration of H840 (e.g., from A840 of a dCas9) does not result in the cleavage of the target strand containing the A. Such Cas9 variants are able to generate a single-strand DNA break (nick) at a specific location based on the gRNA-defined target sequence, leading to repair of the non-edited strand, ultimately resulting in a T to C change on the non-edited strand.

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 (e.g., variants of SEQ ID NO: 6, 7, 8, 9, or 22) are provided which are at least about 70% identical, at least about 80% identical, at least about 90% identical, at least about 95% identical, at least about 98% identical, at least about 99% identical, at least about 99.5% identical, or at least about 99.9% identical to SEQ ID NO: 6, 7, 8, 9, or 22. In some embodiments, variants of dCas9 (e.g., variants of SEQ ID NO: 6, 7, 8, 9, or 22) are provided having amino acid sequences which are shorter, or longer than SEQ ID NO: 7, 8, 9, or 22, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only a fragment thereof. For example, in some embodiments, a Cas9 fusion protein provided herein comprises a Cas9 fragment, wherein the fragment binds crRNA and tracrRNA or sgRNA, but does not comprise a functional nuclease domain, e.g., in that it comprises only a truncated version of a nuclease domain or no nuclease domain at all.

Exemplary amino acid sequences of suitable Cas9 domains and Cas9 fragments are provided herein, and additional suitable sequences of Cas9 domains and fragments will be apparent to those of skill in the art.

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisl* (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); or *Neisseria. meningitidis* (NCBI Ref: YP_002342100.1).

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the dCas9 comprises the amino acid sequence (SEQ ID NO: 7, 8, 9, or 22). In some embodiments, the Cas9 protein is a Cas9 nickase (nCas9). In some embodiments, the nCas9 comprises the amino acid sequence (SEQ ID NO: 10, 13, 16, or 21). In some embodiments, the Cas9 protein is a nuclease active Cas9. In some embodiments, the nuclease active Cas9 comprises the amino acid sequence (SEQ ID NO: 4, 5, 6, 11, 12, 14, 15, 16, 17, 18, 19, 20, 23, 24, 25, or 26).

Exemplary catalytically inactive Cas9 (dCas9):

(SEQ ID NO: 8)

DKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFH
RLEESFLVEEDKKHERHPIFGNIVDEVAYHEKYPTIYHLRKKLVDSTDK
ADLRLIYLALAHMIKFRGHFLIEGDLNPDNSDVDKLFIQLVQTYNQLFE
ENPINASGVDAKAILSARLSKSRRLENLIAQLPGEKKNGLFGNLIALSL
GLTPNFKSNFDLAEDAKLQLSKDTYDDDLDNLLAQIGDQYADLFLAAKN
LSDAILLSDILRVNTEITKAPLSASMIKRYDEHHQDLTLLKALVRQQLP
EKYKEIFFDQSKNGYAGYIDGGASQEEFYKFIKPILEKMDGTEELLVKL
NREDLLRKQRTFDNGSIPHQIHLGELHAILRRQEDFYPFLKDNREKIEK
ILTFRIPYYVGPLARGNSRFAWMTRKSEETITPWNFEEVVDKGASAQSF
IERMTNFDKNLPNEKVLPKHSLLYEYFTVYNELTKVKYVTEGMRKPAFL
SGEQKKAIVDLLFKTNRKVTVKQLKEDYFKKIECFDSVETSGVEDRFNA
SLGTYHDLLKIIKDKDFLDNEENEDILEDIVLTLTLFEDREMIEERLKT
YAHLFDDKVMKQLKRRRYTGWGRLSRKLINGIRDKQSGKTILDFLKSDG
FANRNFMQLIHDDSLTFKEDIQKAQVSGQGDSLHEHIANLAGSPAIKKG
ILQTVKVVDELVKVMGRHKPENIVIEMARENQTTQKGQKNSRERMKRIE
EGIKELGSQILKEHPVENTQLQNEKLYLYYLQNGRDMYVDQELDINRLS
DYDVDAIVPQSFLKDDSIDNKVLTRSDKNRGKSDNVPSEEVVKKMKNYW
RQLLNAKLITQRKFDNLTKAERGGLSELDKAGFIKRQLVETRQITKHVA
QILDSRMNTKYDENDKLIREVKVITLKSKLVSDFRKDFQFYKVREINNY
HHAHDAYLNAVVGTALIKKYPKLESEFVYGDYKVYDVRKMIAKSEQEIG
KATAKYFFYSNIMNFFKTEITLANGEIRKRPLIETNGETGEIVWDKGRD
FATVRKVLSMPQVNIVKKTEVQTGGFSKESILPKRNSDKLIARKKDWDP
KKYGGFDSPTVAYSVLVVAKVEKGKSKKLKSVKELLGITIMERSSFEKN
PIDFLEAKGYKEVKKDLIIKLPKYSLFELENGRKRMLASAGELQKGNEL
ALPSKYVNFLYLASHYEKLKGSPEDNEQKQLFVEQHKHYLDEIIEQISE
FSKRVILADANLDKVLSAYNKHRDKPIREQAENIIHLFTLTNLGAPAAF
KYFDTTIDRKRYTSTKEVLDATLIHQSITGLYETRIDLSQLGGD

Exemplary Cas9 nickase (nCas9):

(SEQ ID NO: 10)

DKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFH
RLEESFLVEEDKKHERHPIFGNIVDEVAYHEKYPTIYHLRKKLVDSTDK
ADLRLIYLALAHMIKFRGHFLIEGDLNPDNSDVDKLFIQLVQTYNQLFE
ENPINASGVDAKAILSARLSKSRRLENLIAQLPGEKKNGLFGNLIALSL
GLTPNFKSNFDLAEDAKLQLSKDTYDDDLDNLLAQIGDQYADLFLAAKN
LSDAILLSDILRVNTEITKAPLSASMIKRYDEHHQDLTLLKALVRQQLP
EKYKEIFFDQSKNGYAGYIDGGASQEEFYKFIKPILEKMDGTEELLVKL
NREDLLRKQRTFDNGSIPHQIHLGELHAILRRQEDFYPFLKDNREKIEK
ILTFRIPYYVGPLARGNSRFAWMTRKSEETITPWNFEEVVDKGASAQSF
IERMTNFDKNLPNEKVLPKHSLLYEYFTVYNELTKVKYVTEGMRKPAFL

-continued

SGEQKKAIVDLLFKTNRKVTVKQLKEDYFKKIECFDSVETSGVEDRFNA
SLGTYHDLLKIIKDKDFLDNEENEDILEDIVLTLTLFEDREMIEERLKT
YAHLFDDKVMKQLKRRRYTGWGRLSRKLINGIRDKQSGKTILDFLKSDG
FANRNFMQLIHDDSLTFKEDIQKAQVSGQGDSLHEHIANLAGSPAIKKG
ILQTVKVVDELVKVMGRHKPENIVIEMARENQTTQKGQKNSRERMKRIE
EGIKELGSQILKEHPVENTQLQNEKLYLYYLQNGRDMYVDQELDINRLS
DYDVDHIVPQSFLKDDSIDNKVLTRSDKNRGKSDNVPSEEVVKKMKNYW
RQLLNAKLITQRKFDNLTKAERGGLSELDKAGFIKRQLVETRQITKHVA
QILDSRMNTKYDENDKLIREVKVITLKSKLVSDFRKDFQFYKVREINNY
HHAHDAYLNAVVGTALIKKYPKLESEFVYGDYKVYDVRKMIAKSEQEIG
KATAKYFFYSNIMNFFKTEITLANGEIRKRPLIETNGETGEIVWDKGRD
FATVRKVLSMPQVNIVKKTEVQTGGFSKESILPKRNSDKLIARKKDWDP
KKYGGFDSPTVAYSVLVVAKVEKGKSKKLKSVKELLGITIMERSSFEKN
PIDFLEAKGYKEVKKDLIIKLPKYSLFELENGRKRMLASAGELQKGNEL
ALPSKYVNFLYLASHYEKLKGSPEDNEQKQLFVEQHKHYLDEIIEQISE
FSKRVILADANLDKVLSAYNKHRDKPIREQAENIIHLFTLTNLGAPAAF
KYFDTTIDRKRYTSTKEVLDATLIHQSITGLYETRIDLSQLGGD

Exemplary catalytically active Cas9:

(SEQ ID NO: 11)

DKKYSIGLDIGTNSVGWAVITDEYKVPSKKFKVLGNTDRHSIKKNLIGA
LLFDSGETAEATRLKRTARRRYTRRKNRICYLQEIFSNEMAKVDDSFFH
RLEESFLVEEDKKHERHPIFGNIVDEVAYHEKYPTIYHLRKKLVDSTDK
ADLRLIYLALAHMIKFRGHFLIEGDLNPDNSDVDKLFIQLVQTYNQLFE
ENPINASGVDAKAILSARLSKSRRLENLIAQLPGEKKNGLFGNLIALSL
GLTPNFKSNFDLAEDAKLQLSKDTYDDDLDNLLAQIGDQYADLFLAAKN
LSDAILLSDILRVNTEITKAPLSASMIKRYDEHHQDLTLLKALVRQQLP
EKYKEIFFDQSKNGYAGYIDGGASQEEFYKFIKPILEKMDGTEELLVKL
NREDLLRKQRTFDNGSIPHQIHLGELHAILRRQEDFYPFLKDNREKIEK
ILTFRIPYYVGPLARGNSRFAWMTRKSEETITPWNFEEVVDKGASAQSF
IERMTNFDKNLPNEKVLPKHSLLYEYFTVYNELTKVKYVTEGMRKPAFL
SGEQKKAIVDLLFKTNRKVTVKQLKEDYFKKIECFDSVETSGVEDRFNA
SLGTYHDLLKIIKDKDFLDNEENEDILEDIVLTLTLFEDREMIEERLKT
YAHLFDDKVMKQLKRRRYTGWGRLSRKLINGIRDKQSGKTILDFLKSDG
FANRNFMQLIHDDSLTFKEDIQKAQVSGQGDSLHEHIANLAGSPAIKKG
ILQTVKVVDELVKVMGRHKPENIVIEMARENQTTQKGQKNSRERMKRIE
EGIKELGSQILKEHPVENTQLQNEKLYLYYLQNGRDMYVDQELDINRLS
DYDVDHIVPQSFLKDDSIDNKVLTRSDKNRGKSDNVPSEEVVKKMKNYW
RQLLNAKLITQRKFDNLTKAERGGLSELDKAGFIKRQLVETRQITKHVA
QILDSRMNTKYDENDKLIREVKVITLKSKLVSDFRKDFQFYKVREINNY
HHAHDAYLNAVVGTALIKKYPKLESEFVYGDYKVYDVRKMIAKSEQEIG
KATAKYFFYSNIMNFFKTEITLANGEIRKRPLIETNGETGEIVWDKGRD

-continued

FATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKN

PIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKRYTSTKEVLDATLIHQSITGLYETRIDLSQLGGD

The term "Cas9 nickase," as used herein, refers to a Cas9 protein that is capable of cleaving only one strand of a duplexed nucleic acid molecule (e.g., a duplexed DNA molecule). In some embodiments, a Cas9 nickase comprises a D10A mutation and has a histidine at position H840 of SEQ ID NO: 6, or a corresponding mutation in any Cas9 provided, such as any one of SEQ ID NOs: 4-26. For example, a Cas9 nickase may comprise the amino acid sequence as set forth in SEQ ID NO: 10, 13, 16, or 21. Such a Cas9 nickase has an active HNH nuclease domain and is able to cleave the non-targeted strand of DNA, i.e., the strand bound by the gRNA. Further, such a Cas9 nickase has an inactive RuvC nuclease domain and is not able to cleave the targeted strand of the DNA, i.e., the strand where base editing is desired.

In some embodiments, Cas9 refers to a Cas9 from arehaea (e.g. nanoarchaea), which constitute a domain and kingdom of single-celled prokaryotic microbes. In some embodiments, Cas9 refers to CasX or CasY, which have been described in, for example, Burstein et al., "New CRISPR-Cas systems from uncultivated microbes." *Cell Res.* 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napDNAbp), and are within the scope of this disclosure.

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the CasX protein is a nuclease inactive CasX protein (dCasX), a CasX nickase (CasXn), or a nuclease active CasX. In some embodiments, the napDNAbp is a CasY protein. In some embodiments, the CasY protein is a nuclease inactive CasY protein (dCasY), a CasY nickase (CasYn), or a nuclease active CasY. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 27-29. In some embodiments, the napDNAbp comprises an amino acid sequence of any one SEQ ID NOs: 27-29. It should be appreciated that CasX and CasY from other bacterial species may also be used in accordance with the present disclosure.

CasX (uniprot.org/uniprot/F0NN87; uniprot.org/uniprot/F0NH53)
>tr|F0NN87|F0NN87_SULIH CRISPR-associated Casx protein OS = *Sulfolobus islandicus* (strain HVE10/4) GN = SiH_0402 PE = 4 SV = 1

(SEQ ID NO: 27)

MEVPLYNIFGDNYIIQVATEAENSTIYNNKVEIDDEELRNVLNLAYKIAKNNEDAAAE

RRGKAKKKKGEEGETTTSNIILPLSGNDKNPWTETLKCYNFPTTVALSEVFKNFSQV

KECEEVSAPSFVKPEFYEFGRSPGMVERTRRVKLEVEPHYLIIAAAGWVLTRLGKAK

VSEGDYVGVNVFTPTRGILYSLIQNVNGIVPGIKPETAFGLWIARKVVSSVTNPNVSV

VRIYTISDAVGQNPTTINGGFSIDLTKLLEKRYLLSERLEAIARNALSISSNMRERYIVL

ANYIYEYLTGSKRLEDLLYFANRDLIMNLNSDDGKVRDLKLISAYVNGELIRGEG

>tr|F0NH53|F0NH53_SULIR CRISPR associated protein, Casx OS = *Sulfolobus islandicus* (strain REY15A) GN = SiRe_0771 PE = 4 SV = 1

(SEQ ID NO: 28)

MEVPLYNIFGDNYIIQVATEAENSTIYNNKVEIDDEELRNVLNLAYKIAKNNEDAAAE

RRGKAKKKKGEEGETTTSNIILPLSGNDKNPWTETLKCYNFPTTVALSEVFKNFSQV

KECEEVSAPSFVKPEFYKFGRSPGMVERTRRVKLEVEPHYLIMAAAGWVLTRLGKA

KVSEGDYVGVNVFTPTRGILYSLIQNVNGIVPGIKPETAFGLWIARKVVSSVTNPNVS

VVSIYTISDAVGQNPTTINGGFSIDLTKLLEKRDLLSERLEAIARNALSISSNMRERYIV

LANYIYEYLTGSKRLEDLLYFANRDLIMNLNSDDGKVRDLKLISAYVNGELIRGEG

-continued

```
CasY (ncbi.nlm.nih.gov/protein/APG80656.1)
>APG80656.1 CRISPR-associated protein CasY [uncultured Parcubacteria
group bacterium]
                                                        (SEQ ID NO: 29)
MSKRHPRISGVKGYRLHAQRLEYTGKSGAMRTIKYPLYSSPSGGRTVPREIVSAINDD

YVGLYGLSNFDDLYNAEKRNEEKVYSVLDFWYDCVQYGAVFSYTAPGLLKNVAEV

RGGSYELTKTLKGSHLYDELQIDKVIKFLNKKEISRANGSLDKLKKDIIDCFKAEYRE

RHKDQCNKLADDIKNAKKDAGASLGERQKKLFRDFFGISEQSENDKPSFTNPLNLTC

CLLPFDTVNNNRNRGEVLFNKLKEYAQKLDKNEGSLEMWEYIGIGNSGTAFSNFLGE

GFLGRLRENKITELKKAMMDITDAWRGQEQEEELEKRLRILAALTIKLREPKFDNHW

GGYRSDINGKLSSWLQNYINQTVKIKEDLKGHKKDLKKAKEMINRFGESDTKEEAV

VSSLLESIEKIVPDDSADDEKPDIPAIAIYRRFLSDGRLTLNRFVQREDVQEALIKERLE

AEKKKKPKKRKKKSDAEDEKETIDFKELFPHLAKPLKLVPNFYGDSKRELYKKYKN

AAIYTDALWKAVEKIYKSAFSSSLKNSFFDTDFDKDFFIKRLQKIFSVYRRFNTDKWK

PIVKNSFAPYCDIVSLAENEVLYKPKQSRSRKSAAIDKNRVRLPSTENIAKAGIALARE

LSVAGFDWKDLLKKEEHEEYIDLIELHKTALALLLAVTETQLDISALDFVENGTVKD

FMKTRDGNLVLEGRFLEMFSQSIVFSELRGLAGLMSRKEFITRSAIQTMNGKQAELL

YIPHEFQSAKITTPKEMSRAFLDLAPAEFATSLEPESLSEKSLLKLKQMRYYPHYFGY

ELTRTGQGIDGGVAENALRLEKSPVKKREIKCKQYKTLGRGQNKIVLYVRSSYYQTQ

FLEWFLHRPKNVQTDVAVSGSFLIDEKKVKTRWNYDALTVALEPVSGSERVFVSQPF

TIFPEKSAEEEGQRYLGIDIGEYGIAYTALEITGDSAKILDQNFISDPQLKTLREEVKGL

KLDQRRGTFAMPSTKIARIRESLVHSLRNRIHHLALKHKAKIVYELEVSRFEEGKQKI

KKVYATLKKADVYSEIDADKNLQTTVWGKLAVASEISASYTSQFCGACKKLWRAE

MQVDETITTQELIGTVRVIKGGTLIDAIKDFMRPPIFDENDTPFPKYRDFCDKHHISKK

MRGNSCLFICPFCRANADADIQASQTIALLRYVKEEKKVEDYFERFRKLKNIKVLGQ

MKKI
```

The term “effective amount,” as used herein, refers to an amount of a biologically active agent that is sufficient to elicit a desired biological response. For example, in some embodiments, an effective amount of a nucleobase editor may refer to the amount of the nucleobase editor that is sufficient to induce a mutation of a target site specifically bound by the nucleobase editor. In some embodiments, an effective amount of a fusion protein provided herein, e.g., of a fusion protein comprising a nucleic acid programmable DNA binding protein and a deaminase domain (e.g., a cytidine deaminase domain) may refer to the amount of the fusion protein that is sufficient to induce editing of a target site specifically bound and edited by the fusion protein. As will be appreciated by the skilled artisan, the effective amount of an agent, e.g., a fusion protein, a nucleobase editor, a deaminase, a hybrid protein, a protein dimer, a complex of a protein (or protein dimer) and a polynucleotide, or a polynucleotide, may vary depending on various factors as, for example, on the desired biological response, e.g., on the specific allele, genome, or target site to be edited, on the cell or tissue being targeted, and on the agent being used.

The terms “nucleic acid” and “nucleic acid molecule,” as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, “nucleic acid” refers to individual nucleic acid residues (e.g. nucleotides and/or nucleosides). In some embodiments, “nucleic acid” refers to an oligonucleotide chain comprising three or more individual nucleotide residues. As used herein, the terms “oligonucleotide” and “polynucleotide” can be used interchangeably to refer to a polymer of nucleotides (e.g., a string of at least three nucleotides). In some embodiments, “nucleic acid” encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms “nucleic acid,” “DNA,” “RNA,” and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 0(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

The term "proliferative disease," as used herein, refers to any disease in which cell or tissue homeostasis is disturbed in that a cell or cell population exhibits an abnormally elevated proliferation rate. Proliferative diseases include hyperproliferative diseases, such as pre-neoplastic hyperplastic conditions and neoplastic diseases. Neoplastic diseases are characterized by an abnormal proliferation of cells and include both benign and malignant neoplasias. Malignant neoplasia is also referred to as cancer.

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof.

The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a nucleic-acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* ($4^{th}$ ed., Cold Spring Harbor Laboratory Press, Cold Spring Harbor, N.Y. (2012)), the entire contents of which are incorporated herein by reference.

The term "RNA-programmable nuclease," and "RNA-guided nuclease" are used interchangeably herein and refer to a nuclease that forms a complex with (e.g., binds or associates with) one or more RNA(s) that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et al., *Science* 337:816-821(2012), the entire contents of which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases And Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRISPR-associated system) Cas9 endonuclease, for example, Cas9 (Csnl) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference.

Because RNA-programmable nucleases (e.g., Cas9) use RNA:DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al., Multiplex genome engineering using CRISPR/Cas systems. *Science* 339, 819-823 (2013); Mali, P. et al., RNA-guided human genome engineering via Cas9. *Science* 339, 823-826 (2013); Hwang, W. Y. et al., Efficient genome editing in zebrafish using a CRISPR-Cas system. *Nature biotechnology* 31, 227-229 (2013); Jinek, M. et al., RNA-programmed genome editing in human cells. *eLife* 2, e00471 (2013); Dicarlo, J. E. et al., Genome engineering in *Saccharomyces cerevisiae* using CRISPR-Cas systems. *Nucleic acids research* (2013); Jiang, W. et al. RNA-guided editing of bacterial genomes using CRISPR-Cas systems. *Nature biotechnology* 31, 233-239 (2013); the entire contents of each of which are incorporated herein by reference).

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development.

The term "target site" refers to a sequence within a nucleic acid molecule that is modified by a base editor, such as a fusion protein comprising a cytidine deaminase, (e.g., a dCas9-cytidine deaminase fusion protein provided herein).

The terms "treatment," "treat," and "treating," refer to a clinical intervention aimed to reverse, alleviate, delay the onset of, or inhibit the progress of a disease or disorder, or one or more symptoms thereof, as described herein. As used herein, the terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

DETAILED DESCRIPTION OF INVENTION

Nucleic Acid Programmable DNA Binding Proteins (napDNAbp)

Some aspects of the disclosure provide nucleic acid programmable DNA binding proteins, which may be used to guide a protein, such as a base editor, to a specific nucleic acid (e.g., DNA or RNA) sequence. Nucleic acid programmable DNA binding proteins include, without limitation, Cas9 (e.g., dCas9 and nCas9), CasX, CasY, Cpf1, C2c1, C2c2, C2C3, and Argonaute. One example of a nucleic acid programmable DNA-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from *Acidaminococcus* and Lachnospiraceae are shown to have efficient genome-editing activity in human cells. Cpf1 proteins are known in the art and have been described previously, for example Yamano et al., "Crystal structure of Cpf1 in complex with guide RNA and target DNA." *Cell* (165) 2016, p. 949-962; the entire contents of which is hereby incorporated by reference.

Also useful in the present compositions and methods are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. It was shown in Zetsche et al., *Cell,* 163, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D917A, E1006A, or D1255A in *Francisella novicida* Cpf1 (SEQ ID NO: 30) inactivates Cpf1 nuclease activity. In some embodiments, the dCpf1 of the present disclosure comprises mutations corresponding to D917A, E1006A, D1255A, D917A/E1006A, D917A/D1255A, E1006A/D1255A, or D917A/E1006A/D1255A in SEQ ID NO: 30, or corresponding mutation(s) in another Cpf1. It is to be understood that any mutations, e.g., substitution mutations, deletions, or insertions that inactivate the RuvC domain of Cpf1, may be used in accordance with the present disclosure.

In some embodiments, the nucleic acid programmable DNA binding protein (napDNAbp) of any of the fusion proteins provided herein may be a Cpf1 protein. In some embodiments, the Cpf1 protein is a Cpf1 nickase (nCpf1). In some embodiments, the Cpf1 protein is a nuclease inactive Cpf1 (dCpf1). In some embodiments, the Cpf1, the nCpf1, or the dCpf1 comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 30-37. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 30-37, and comprises mutations corresponding to D917A, E1006A, D1255A, D917A/E1006A, D917A/D1255A, E1006A/D1255A, and or D917A/E1006A/D1255A in SEQ ID NO: 30 or corresponding mutation(s) inahother Cpf1. In some embodiments, the dCpf1 comprises an amino acid sequence of any one SEQ ID NOs: 30-37. It should be appreciated that Cpf1 from other bacterial species may also be used in accordance with the present disclosure.

Wild type *Francisella novicida* Cpf1 (SEQ ID NO: 30) (D917, E1006, and D1255 are bolded and underlined)

(SEQ ID NO: 30)

MSIYQEFVNKYSLSKTLRFELIPQGKTLENIKARGLILDDEKRAKDYKKAK

QIIDKYHQFFIEEILSSVCISEDLLQNYSDVYFKLKKSDDDNLQKDFKSAKDTIKKQISE

YIKDSEKFKNLFNQNLIDAKKGQESDLILWLKQSKDNGIELFKANSDITDIDEALEIIK

SFKGWTTYFKGFHENRKNVYSSNDIPTSITYRIVDDNLPKFLENKAKYESLKDKAPEA

INYEQIKKDLAEELTFDIDYKTSEVNQRVFSLDEVFEIANFNNYLNQSGITKFNTIIGG

KFVNGENTKRKGINEYINLYSQQINDKTLKKYKMSVLFKQILSDTESKSFVIDKLEDD

SDVVTTMQSFYEQIAAFKTVEEKSIKETLSLLFDDLKAQKLDLSKIYFKNDKSLTDLS

QQVFDDYSVIGTAVLEYITQQIAPKNLDNPSKKEQELIAKKTEKAKYLSLETIKLALE

EFNKHRDIDKQCRFEEILANFAAIPMIFDEIAQNKDNLAQISIKYQNQGKKDLLQASA

EDDVKAIKDLLDQTNNLLHKLKIFHISQSEDKANILDKDEHFYLVFEECYFELANIVP

LYNKIRNYITQKPYSDEKFKLNFENSTLANGWDKNKEPDNTAILFIKDDKYYLGVMN

KKNNKIFDDKAIKENKGEGYKKIVYKLLPGANKMLPKVFFSAKSIKFYNPSEDILRIR

NHSTHTKNGSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGRPNLHTLY

WKALFDERNLQDVVYKLNGEAELFYRKQSIPKKITHPAKEAIANKNKDNPKKESVFE

YDLIKDKRFTEDKFFFHCPITINFKSSGANKFNDEINLLLKEKANDVHILSIDRGERHL

AYYTLVDGKGNIIKQDTFNIIGNDRMKTNYHDKLAAIEKDRDSARKDWKKINNIKE

MKEGYLSQVVHEIAKLVIEYNAIVVFEDLNFGFKRGRFKVEKQVYQKLEKMLIEKLN

YLVFKDNEFDKTGGVLRAYQLTAPFETFKKMGKQTGIIYYVPAGFTSKICPVTGFVN

QLYPKYESVSKSQEFFSKFDKICYNLDKGYFEFSFDYKNFGDKAAKGKWTIASFGSR

LINFRNSDKNHNWDTREVYPTKELEKLLKDYSIEYGHGECIKAAICGESDKKFFAKLT

SVLNTILQMRNSKTGTELDYLISPVADVNGNFFDSRQAPKNMPQDADANGAYHIGL

KGLMLLGRIKNNQEGKKLNLVIKNEEYFEFVQNRNN

*Francisella novicida* Cpf1 D917A (SEQ ID NO: 31) (A917, E1006, and D1255 are bolded and underlined)

(SEQ ID NO: 31)

MSIYQEFVNKYSLSKTLRFELIPQGKTLENIKARGLILDDEKRAKDYKKAK

QIIDKYHQFFIEEILSSVCISEDLLQNYSDVYFKLKKSDDDNLQKDFKSAKDTIKKQISE

YIKDSEKFKNLFNQNLIDAKKGQESDLILWLKQSKDNGIELFKANSDITDIDEALEIIK

SFKGWTTYFKGFHENRKNVYSSNDIPTSITYRIVDDNLPKFLENKAKYESLKDKAPEA

INYEQIKKDLAEELTFDIDYKTSEVNQRVFSLDEVFEIANFNNYLNQSGITKFNTIIGG

KFVNGENTKRKGINEYINLYSQQINDKTLKKYKMSVLFKQILSDTESKSFVIDKLEDD

SDVVTTMQSFYEQIAAFKTVEEKSIKETLSLLFDDLKAQKLDLSKIYFKNDKSLTDLS

QQVFDDYSVIGTAVLEYITQQIAPKNLDNPSKKEQELIAKKTEKAKYLSLETIKLALE

EFNKHRDIDKQCRFEEILANFAAIPMIFDEIAQNKDNLAQISIKYQNQGKKDLLQASA

EDDVKAIKDLLDQTNNLLHKLKIFHISQSEDKANILDKDEHFYLVFEECYFELANIVP

-continued

LYNKIRNYITQKPYSDEKFKLNFENSTLANGWDKNKEPDNTAILFIKDDKYYLGVMN

KKNNKIFDDKAIKENKGEGYKKIVYKLLPGANKMLPKVFFSAKSIKFYNPSEDILRIR

NHSTHTKNGSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGRPNLHTLY

WKALFDERNLQDVVYKLNGEAELFYRKQSIPKKITHPAKEAIANKNKDNPKKESVFE

YDLIKDKRFTEDKFFFHCPITINFKSSGANKFNDEINLLLKEKANDVHILSIARGERHL

AYYTLVDGKGNIIKQDTFNIIGNDRMKTNYHDKLAAIEKDRDSARKDWKKINNIKE

MKEGYLSQVVHEIAKLVIEYNAIVVFEDLNFGFKRGRFKVEKQVYQKLEKMLIEKLN

YLVFKDNEFDKTGGVLRAYQLTAPFETFKKMGKQTGIIYYVPAGFTSKICPVTGFVN

QLYPKYESVSKSQEFFSKFDKICYNLDKGYFEFSFDYKNFGDKAAKGKWTIASFGSR

LINFRNSDKNHNWDTREVYPTKELEKLLKDYSIEYGHGECIKAAICGESDKKFFAKLT

SVLNTILQMRNSKTGTELDYLISPVADVNGNFFDSRQAPKNMPQDADANGAYHIGL

KGLMLLGRIKNNQEGKKLNLVIKNEEYFEFVQNRNN

*Francisella novicida* Cpf1 E1006A (SEQ ID NO: 32) (D917, A1006, and D1255 are bolded and underlined)

(SEQ ID NO: 32)

MSIYQEFVNKYSLSKTLRFELIPQGKTLENIKARGLILDDEKRAKDYKKAK

QIIDKYHQFFIEEILSSVCISEDLLQNYSDVYFKLKKSDDDNLQKDFKSAKDTIKKQISE

YIKDSEKFKNLFNQNLIDAKKGQESDLILWLKQSKDNGIELFKANSDITDIDEALEIIK

SFKGWTTYFKGFHENRKNVYSSNDIPTSIIYRIVDDNLPKFLENKAKYESLKDKAPEA

INYEQIKKDLAEELTFDIDYKTSEVNQRVFSLDEVFEIANFNNYLNQSGITKFNTIIGG

KFVNGENTKRKGINEYINLYSQQINDKTLKKYKMSVLFKQILSDTESKSFVIDKLEDD

SDVVTTMQSFYEQIAAFKTVEEKSIKETLSLLFDDLKAQKLDLSKIYFKNDKSLTDLS

QQVFDDYSVIGTAVLEYITQQIAPKNLDNPSKKEQELIAKKTEKAKYLSLETIKLALE

EFNKHRDIDKQCRFEEILANFAAIPMIFDEIAQNKDNLAQISIKYQNQGKKDLLQASA

EDDVKAIKDLLDQTNNLLHKLKIFHISQSEDKANILDKDEHFYLVFEECYFELANIVP

LYNKIRNYITQKPYSDEKFKLNFENSTLANGWDKNKEPDNTAILFIKDDKYYLGVMN

KKNNKIFDDKAIKENKGEGYKKIVYKLLPGANKMLPKVFFSAKSIKFYNPSEDILRIR

NHSTHTKNGSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGRPNLHTLY

WKALFDERNLQDVVYKLNGEAELFYRKQSIPKKITHPAKEAIANKNKDNPKKESVFE

YDLIKDKRFTEDKFFFHCPITINFKSSGANKFNDEINLLLKEKANDVHILSIDRGERHL

AYYTLVDGKGNIIKQDTFNIIGNDRMKTNYHDKLAAIEKDRDSARKDWKKINNIKE

MKEGYLSQVVHEIAKLVIEYNAIVVFADLNFGFKRGRFKVEKQVYQKLEKMLIEKL

NYLVFKDNEFDKTGGVLRAYQLTAPFETFKKMGKQTGIIYYVPAGFTSKICPVTGFV

NQLYPKYESVSKSQEFFSKFDKICYNLDKGYFEFSFDYKNFGDKAAKGKWTIASFGS

RLINFRNSDKNHNWDTREVYPTKELEKLLKDYSIEYGHGECIKAAICGESDKKFFAK

LTSVLNTILQMRNSKTGTELDYLISPVADVNGNFFDSRQAPKNMPQDADANGAYHIG

LKGLMLLGRIKNNQEGKKLNLVIKNEEYFEFVQNRNN

*Francisella novicida* Cpf1 D1255A (SEQ ID NO: 33) (D917, E1006, and A1255 are bolded and underlined)

(SEQ ID NO: 33)

MSIYQEFVNKYSLSKTLRFELIPQGKTLENIKARGLILDDEKRAKDYKKAK

QIIDKYHQFFIEEILSSVCISEDLLQNYSDVYFKLKKSDDDNLQKDFKSAKDTIKKQISE

-continued

YIKDSEKFKNLFNQNLIDAKKGQESDLILWLKQSKDNGIELFKANSDITDIDEALEIIK

SFKGWTTYFKGFHENRKNVYSSNDIPTSIIYRIVDDNLPKFLENKAKYESLKDKAPEA

INYEQIKKDLAEELTFDIDYKTSEVNQRVFSLDEVFEIANFNNYLNQSGITKFNTIIGG

KFVNGENTKRKGINEYINLYSQQINDKTLKKYKMSVLFKQILSDTESKSFVIDKLEDD

SDVVTTMQSFYEQIAAFKTVEEKSIKETLSLLFDDLKAQKLDLSKIYFKNDKSLTDLS

QQVFDDYSVIGTAVLEYITQQIAPKNLDNPSKKEQELIAKKTEKAKYLSLETIKLALE

EFNKHRDIDKQCRFEEILANFAAIPMIFDEIAQNKDNLAQISIKYQNQGKKDLLQASA

EDDVKAIKDLLDQTNNLLHKLKIFHISQSEDKANILDKDEHFYLVFEECYFELANIVP

LYNKIRNYITQKPYSDEKFKLNFENSTLANGWDKNKEPDNTAILFIKDDKYYLGVMN

KKNNKIFDDKAIKENKGEGYKKIVYKLLPGANKMLPKVFFSAKSIKFYNPSEDILRIR

NHSTHTKNGSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGRPNLHTLY

WKALFDERNLQDVVYKLNGEAELFYRKQSIPKKITHPAKEAIANKNKDNPKKESVFE

YDLIKDKRFTEDKFFFHCPITINFKSSGANKFNDEINLLLKEKANDVHILSIDRGERHL

AYYTLVDGKGNIIKQDTFNIIGNDRMKTNYHDKLAAIEKDRDSARKDWKKINNIKE

MKEGYLSQVVHEIAKLVIEYNAIVVFEDLNFGFKRGRFKVEKQVYQKLEKMLIEKLN

YLVFKDNEFDKTGGVLRAYQLTAPFETFKKMGKQTGIIYYVPAGFTSKICPVTGFVN

QLYPKYESVSKSQEFFSKFDKICYNLDKGYFEFSFDYKNFGDKAAKGKWTIASFGSR

LINFRNSDKNHNWDTREVYPTKELEKLLKDYSIEYGHGECIKAAICGESDKKFFAKLT

SVLNTILQMRNSKTGTELDYLISPVADVNGNFFDSRQAPKNMPQDAAANGAYHIGL

KGLMLLGRIKNNQEGKKLNLVIKNEEYFEFVQNRNN

*Francisella novicida* Cpf1 D917A/E1006A (SEQ ID NO: 34) (A917, A1006, and D1255 are bolded and underlined)

(SEQ ID NO: 34)

MSIYQEFVNKYSLSKTLRFELIPQGKTLENIKARGLILDDEKRAKDYKKAK

QIIDKYHQFFIEEILSSVCISEDLLQNYSDVYFKLKKSDDDNLQKDFKSAKDTIKKQISE

YIKDSEKFKNLFNQNLIDAKKGQESDLILWLKQSKDNGIELFKANSDITDIDEALEIIK

SFKGWTTYFKGFHENRKNVYSSNDIPTSIIYRIVDDNLPKFLENKAKYESLKDKAPEA

INYEQIKKDLAEELTFDIDYKTSEVNQRVFSLDEVFEIANFNNYLNQSGITKFNTIIGG

KFVNGENTKRKGINEYINLYSQQINDKTLKKYKMSVLFKQILSDTESKSFVIDKLEDD

SDVVTTMQSFYEQIAAFKTVEEKSIKETLSLLFDDLKAQKLDLSKIYFKNDKSLTDLS

QQVFDDYSVIGTAVLEYITQQIAPKNLDNPSKKEQELIAKKTEKAKYLSLETIKLALE

EFNKHRDIDKQCRFEEILANFAAIPMIFDEIAQNKDNLAQISIKYQNQGKKDLLQASA

EDDVKAIKDLLDQTNNLLHKLKIFHISQSEDKANILDKDEHFYLVFEECYFELANIVP

LYNKIRNYITQKPYSDEKFKLNFENSTLANGWDKNKEPDNTAILFIKDDKYYLGVMN

KKNNKIFDDKAIKENKGEGYKKIVYKLLPGANKMLPKVFFSAKSIKFYNPSEDILRIR

NHSTHTKNGSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGRPNLHTLY

WKALFDERNLQDVVYKLNGEAELFYRKQSIPKKITHPAKEAIANKNKDNPKKESVFE

YDLIKDKRFTEDKFFFHCPITINFKSSGANKFNDEINLLLKEKANDVHILSIARGERHL

AYYTLVDGKGNIIKQDTFNIIGNDRMKTNYHDKLAAIEKDRDSARKDWKKINNIKE

MKEGYLSQVVHEIAKLVIEYNAIVVFADLNFGFKRGRFKVEKQVYQKLEKMLIEKL

-continued

NYLVFKDNEFDKTGGVLRAYQLTAPFETFKKMGKQTGIIYYVPAGFTSKICPVTGFV

NQLYPKYESVSKSQEFFSKFDKICYNLDKGYFEFSFDYKNFGDKAAKGKWTIASFGS

RLINFRNSDKNHNWDTREVYPTKELEKLLKDYSIEYGHGECIKAAICGESDKKFFAK

LTSVLNTILQMRNSKTGTELDYLISPVADVNGNFFDSRQAPKNMPQDADANGAYHIG

LKGLMLLGRIKNNQEGKKLNLVIKNEEYFEFVQNRNN

*Francisella novicida* Cpf1 D917A/D1255A (SEQ ID NO: 35) (A917, E1006, and A1255 are bolded and underlined)

(SEQ ID NO: 35)

MSIYQEFVNKYSLSKTLRFELIPQGKTLENIKARGLILDDEKRAKDYKKAK

QIIDKYHQFFIEEILSSVCISEDLLQNYSDVYFKLKKSDDDNLQKDFKSAKDTIKKQISE

YIKDSEKFKNLFNQNLIDAKKGQESDLILWLKQSKDNGIELFKANSDITDIDEALEIIK

SFKGWTTYFKGFHENRKNVYSSNDIPTSIIYRIVDDNLPKFLENKAKYESLKDKAPEA

INYEQIKKDLAEELTFDIDYKTSEVNQRVFSLDEVFEIANFNNYLNQSGITKFNTIIGG

KFVNGENTKRKGINEYINLYSQQINDKTLKKYKMSVLFKQILSDTESKSFVIDKLEDD

SDVVTTMQSFYEQIAAFKTVEEKSIKETLSLLFDDLKAQKLDLSKIYFKNDKSLTDLS

QQVFDDYSVIGTAVLEYITQQIAPKNLDNPSKKEQELIAKKTEKAKYLSLETIKLALE

EFNKHRDIDKQCRFEEILANFAAIPMIFDEIAQNKDNLAQISIKYQNQGKKDLLQASA

EDDVKAIKDLLDQTNNLLHKLKIFHISQSEDKANILDKDEHFYLVFEECYFELANIVP

LYNKIRNYITQKPYSDEKFKLNFENSTLANGWDKNKEPDNTAILFIKDDKYYLGVMN

KKNNKIFDDKAIKENKGEGYKKIVYKLLPGANKMLPKVFFSAKSIKFYNPSEDILRIR

NHSTHTKNGSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGRPNLHTLY

WKALFDERNLQDVVYKLNGEAELFYRKQSIPKKITHPAKEAIANKNKDNPKKESVFE

YDLIKDKRFTEDKFFFHCPITINFKSSGANKFNDEINLLLKEKANDVHILSIARGERHL

AYYTLVDGKGNIIKQDTFNIIGNDRMKTNYHDKLAAIEKDRDSARKDWKKINNIKE

MKEGYLSQVVHEIAKLVIEYNAIVVFEDLNFGFKRGRFKVEKQVYQKLEKMLIEKLN

YLVFKDNEFDKTGGVLRAYQLTAPFETFKKMGKQTGIIYYVPAGFTSKICPVTGFVN

QLYPKYESVSKSQEFFSKFDKICYNLDKGYFEFSFDYKNFGDKAAKGKWTIASFGSR

LINFRNSDKNHNWDTREVYPTKELEKLLKDYSIEYGHGECIKAAICGESDKKFFAKLT

SVLNTILQMRNSKTGTELDYLISPVADVNGNFFDSRQAPKNMPQDAAANGAYHIGL

KGLMLLGRIKNNQEGKKLNLVIKNEEYFEFVQNRNN

*Francisella novicida* Cpf1 E1006A/D1255A (SEQ ID NO: 36) (D917, A1006, and A1255 are bolded and underlined)

(SEQ ID NO: 36)

MSIYQEFVNKYSLSKTLRFELIPQGKTLENIKARGLILDDEKRAKDYKKAK

QIIDKYHQFFIEEILSSVCISEDLLQNYSDVYFKLKKSDDDNLQKDFKSAKDTIKKQISE

YIKDSEKFKNLFNQNLIDAKKGQESDLILWLKQSKDNGIELFKANSDITDIDEALEIIK

SFKGWTTYFKGFHENRKNVYSSNDIPTSIIYRIVDDNLPKFLENKAKYESLKDKAPEA

INYEQIKKDLAEELTFDIDYKTSEVNQRVFSLDEVFEIANFNNYLNQSGITKFNTIIGG

KFVNGENTKRKGINEYINLYSQQINDKTLKKYKMSVLFKQILSDTESKSFVIDKLEDD

SDVVTTMQSFYEQIAAFKTVEEKSIKETLSLLFDDLKAQKLDLSKIYFKNDKSLTDLS

QQVFDDYSVIGTAVLEYITQQIAPKNLDNPSKKEQELIAKKTEKAKYLSLETIKLALE

EFNKHRDIDKQCRFEEILANFAAIPMIFDEIAQNKDNLAQISIKYQNQGKKDLLQASA

-continued

EDDVKAIKDLLDQTNNLLHKLKIFHISQSEDKANILDKDEHFYLVFEECYFELANIVP

LYNKIRNYITQKPYSDEKFKLNFENSTLANGWDKNKEPDNTAILFIKDDKYYLGVMN

KKNNKIFDDKAIKENKGEGYKKIVYKLLPGANKMLPKVFFSAKSIKFYNPSEDILRIR

NHSTHTKNGSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGRPNLHTLY

WKALFDERNLQDVVYKLNGEAELFYRKQSIPKKITHPAKEAIANKNKDNPKKESVFE

YDLIKDKRFTEDKFFFHCPITINFKSSGANKFNDEINLLLKEKANDVHILSIDRGERHL

AYYTLVDGKGNIIKQDTFNIIGNDRMKTNYHDKLAAIEKDRDSARKDWKKINNIKE

MKEGYLSQVVHEIAKLVIEYNAIVVFADLNFGFKRGRFKVEKQVYQKLEKMLIEKL

NYLVFKDNEFDKTGGVLRAYQLTAPFETFKKMGKQTGIIYYVPAGFTSKICPVTGFV

NQLYPKYESVSKSQEFFSKFDKICYNLDKGYFEFSFDYKNFGDKAAKGKWTIASFGS

RLINFRNSDKNHNWDTREVYPTKELEKLLKDYSIEYGHGECIKAAICGESDKKFFAK

LTSVLNTILQMRNSKTGTELDYLISPVADVNGNFFDSRQAPKNMPQDAAANGAYHIG

LKGLMLLGRIKNNQEGKKLNLVIKNEEYFEFVQNRNN

*Francisella novicida* Cpf1 D917A/E1006A/D1255A (SEQ ID NO: 37) (A917, A1006, and A1255 are bolded and underlined)

(SEQ ID NO: 37)

MSIYQEFVNKYSLSKTLRFELIPQGKTLENIKARGLILDDEKRAKDYKKAK

QIIDKYHQFFIEEILSSVCISEDLLQNYSDVYFKLKKSDDDNLQKDFKSAKDTIKKQISE

YIKDSEKFKNLFNQNLIDAKKGQESDLILWLKQSKDNGIELFKANSDITDIDEALEIIK

SFKGWTTYFKGFHENRKNVYSSNDIPTSIIYRIVDDNLPKFLENKAKYESLKDKAPEA

INYEQIKKDLAEELTFDIDYKTSEVNQRVFSLDEVFEIANFNNYLNQSGITKFNTIIGG

KFVNGENTKRKGINEYINLYSQQINDKTLKKYKMSVLFKQILSDTESKSFVIDKLEDD

SDVVTTMQSFYEQIAAFKTVEEKSIKETLSLLFDDLKAQKLDLSKIYFKNDKSLTDLS

QQVFDDYSVIGTAVLEYITQQIAPKNLDNPSKKEQELIAKKTEKAKYLSLETIKLALE

EFNKHRDIDKQCRFEEILANFAAIPMIFDEIAQNKDNLAQISIKYQNQGKKDLLQASA

EDDVKAIKDLLDQTNNLLHKLKIFHISQSEDKANILDKDEHFYLVFEECYFELANIVP

LYNKIRNYITQKPYSDEKFKLNFENSTLANGWDKNKEPDNTAILFIKDDKYYLGVMN

KKNNKIFDDKAIKENKGEGYKKIVYKLLPGANKMLPKVFFSAKSIKFYNPSEDILRIR

NHSTHTKNGSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGRPNLHTLY

WKALFDERNLQDVVYKLNGEAELFYRKQSIPKKITHPAKEAIANKNKDNPKKESVFE

YDLIKDKRFTEDKFFFHCPITINFKSSGANKFNDEINLLLKEKANDVHILSIARGERHL

AYYTLVDGKGNIIKQDTFNIIGNDRMKTNYHDKLAAIEKDRDSARKDWKKINNIKE

MKEGYLSQVVHEIAKLVIEYNAIVVFADLNFGFKRGRFKVEKQVYQKLEKMLIEKL

NYLVFKDNEFDKTGGVLRAYQLTAPFETFKKMGKQTGIIYYVPAGFTSKICPVTGFV

NQLYPKYESVSKSQEFFSKFDKICYNLDKGYFEFSFDYKNFGDKAAKGKWTIASFGS

RLINFRNSDKNHNWDTREVYPTKELEKLLKDYSIEYGHGECIKAAICGESDKKFFAK

LTSVLNTILQMRNSKTGTELDYLISPVADVNGNFFDSRQAPKNMPQDAAANGAYHIG

LKGLMLLGRIKNNQEGKKLNLVIKNEEYFEFVQNRNN

In some embodiments, the nucleic acid programmable DNA binding protein (napDNAbp) is a nucleic acid programmable DNA binding protein that does not require a canonical (NGG) PAM sequence. In some embodiments, the napDNAbp is an argonaute protein. One example of such a nucleic acid programmable DNA binding protein is an Argonaute protein from *Natronobacterium gregoryi* (NgAgo). NgAgo is a ssDNA-guided endonuclease. NgAgo binds 5' phosphorylated ssDNA of ~24 nucleotides (gDNA) to guide it to its target site and will make DNA double-strand breaks at the gDNA site. In contrast to Cas9, the NgAgo-gDNA system does not require a protospacer-adjacent motif (PAM). Using a nuclease inactive NgAgo (dNgAgo) can greatly expand the bases that may be targeted. The characterization and use of NgAgo have been described in Gao et al., *Nat Biotechnol.,* 2016 July; 34(7):768-73. PubMed PMID: 27136078; Swarts et al., *Nature.* 507(7491) (2014): 258-61; and Swarts et al., *Nucleic Acids Res.* 43(10) (2015): 5120-9, each of which is incorporated herein by reference. The sequence of *Natronobacterium gregoryi* Argonaute is provided in SEQ ID NO: 38.

```
Wild type Natronobacteriurn gregoryi Argonaute
(SEQ ID NO: 38)
                                   (SEQ ID NO: 38)
MTVIDLDSTTTADELTSGHTYDISVTLTGVYDNTDEQHPRMSLAFEQD

NGERRYITLWKNTTPKDVFTYDYATGSTYIFTNIDYEVKDGYENLTAT

YQTTVENATAQEVGTTDEDETFAGGEPLDHHLDDALNETPDDAETESD

SGHVMTSFASRDQLPEWTLHTYTLTATDGAKTDTEYARRTLAYTVRQE

LYTDHDAAPVATDGLMLLTPEPLGETPLDLDCGVRVEADETRTLDYTT

AKDRLLARELVEEGLKRSLWDDYLVRGIDEVLSKEPVLTCDEFDLHER

YDLSVEVGHSGRAYLHINFRHRFVPKLTLADIDDDNIYPGLRVKTTYR

PRRGHIVWGLRDECATDSLNTLGNQSVVAYHRNNQTPINTDLLDAIEA

ADRRVVETRRQGHGDDAVSFPQELLAVEPNTHQIKQFASDGFHQQARS

KTRLSASRCSEKAQAFAERLDPVRLNGSTVEFSSEFFTGNNEQQLRLL

YENGESVLTFRDGARGAHPDETFSKGIVNPPESFEVAVVLPEQQADTC

KAQWDTMADLLNQAGAPPTRSETVQYDAFSSPESISLNVAGAIDPSEV

DAAFVVLPPDQEGFADLASPTETYDELKKALANMGIYSQMAYFDRFRD

AKIFYTRNVALGLLAAAGGVAFTTEHAMPGDADMFIGIDVSRSYPEDG

ASGQINIAATATAVYKDGTILGHSSTRPQLGEKLQSTDVRDIMKNAIL

GYQQVTGESPTHIVIHRDGFMNEDLDPATEFLNEQGVEYDIVEIRKQP

QTRLLAVSDVQYDTPVKSIAAINQNEPRATVATFGAPEYLATRDGGGL

PRPIQIERVAGETDIETLTRQVYLLSQSHIQVHNSTARLPITTAYADQ

ASTHATKGYLVQTGAFESNVGFL
```

In some embodiments, the napDNAbp is a prokaryotic homolog of an Argonaute protein. Prokaryotic homologs of Argonaute proteins are known and have been described, for example, in Makarova K., et al., "Prokaryotic homologs of Argonaute proteins are predicted to function as key components of a novel system of defense against mobile genetic elements", *Biol Direct.* 2009 Aug. 25; 4:29. doi: 10.1186/1745-6150-4-29, the entire contents of which is hereby incorporated by reference. In some embodiments, the napDNAbp is a *Marinitoga piezophila* Argunaute (MpAgo) protein. The CRISPR-associated *Marinitoga piezophila* Argunaute (MpAgo) protein cleaves single-stranded target sequences using 5'-phosphorylated guides. The 5' guides are used by all known Argonautes. The crystal structure of an MpAgo-RNA complex shows a guide strand binding site comprising residues that block 5' phosphate interactions. This data suggests the evolution of an Argonaute subclass with noncanonical specificity for a 5'-hydroxylated guide. See, e.g., Kaya et al., "A bacterial Argonaute with noncanonical guide RNA specificity", *Proc Natl Acad Sci USA.* 2016 Apr. 12; 113(15):4057-62, the entire contents of which are hereby incorporated by reference). It should be appreciated that other argonaute proteins may be used, and are within the scope of this disclosure.

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, C2c1, C2c2, and C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (C2c1, C2c2, and C2c3) have been described by Shmakov et al., "Discovery and Functional Characterization of Diverse Class 2 CRISPR Cas Systems", *Mol. Cell,* 2015 Nov. 5; 60(3): 385-397, the entire contents of which is hereby incorporated by reference. Effectors of two of the systems, C2c1 and C2c3, contain RuvC-like endonuclease domains related to Cpf1. A third system, C2c2 contains an effector with two predicated HEPN RNase domains. Production of mature CRISPR RNA is tracrRNA-independent, unlike production of CRISPR RNA by C2c1. C2c1 depends on both CRISPR RNA and tracrRNA for DNA cleavage. Bacterial C2c2 has been shown to possess a unique RNase activity for CRISPR RNA maturation distinct from its RNA-activated single-stranded RNA degradation activity. These RNase functions are different from each other and from the CRISPR RNA-processing behavior of Cpf1. See, e.g., East-Seletsky, et al., "Two distinct RNase activities of CRISPR-C2c2 enable guide-RNA processing and RNA detection", *Nature,* 2016 Oct. 13; 538(7624):270-273, the entire contents of which are hereby incorporated by reference. In vitro biochemical analysis of C2c2 in *Leptotrichia shahii* has shown that C2c2 is guided by a single CRISPR RNA and can be programed to cleave ssRNA targets carrying complementary protospacers. Catalytic residues in the two conserved HEPN domains mediate cleavage. Mutations in the catalytic residues generate catalytically inactive RNA-binding proteins. See e.g., Abudayyeh et al., "C2c2 is a single-component programmable RNA-guided RNA-targeting CRISPR effector", *Science,* 2016 Aug. 5; 353(6299), the entire contents of which are hereby incorporated by reference.

The crystal structure of *Alicyclobaccillus acidoterrastris* C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", *Mol. Cell,* 2017 Jan. 19; 65(2):310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease", *Cell,* 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with C2c1-mediated cleavage resulting in a staggered seven-nucleotide break of target DNA. Structural comparisons between C2c1 ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein may be a C2c1, a C2c2, or a C2c3 protein. In some embodiments, the napDNAbp is a C2c1 protein. In some embodiments, the napDNAbp is a C2c2 protein. In some embodiments, the napDNAbp is a C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring C2c1, C2c2, or C2c3 protein. In some embodiments, the napDNAbp is a naturally-occurring C2c1, C2c2, or C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 39-40. It should be appreciated that C2c1, C2c2, or C2c3 from other bacterial species may also be used in accordance with the present disclosure.

C2c1 (uniprot.org/uniprot/T0D7A2#)
sp|T0D7A2|C2C1_ALIAG CRISPR-associated endonuclease C2c1 OS = *Alicyclobacillus acidoterrestris* (strain ATCC 49025/DSM 3922/CIP 106132/NCIMB 13137/GD3B) GN = c2c1 PE = 1 SV = 1

(SEQ ID NO: 39)

MAVKSIKVKLRLDDMPEIRAGLWKLHKEVNAGVRYYTEWLSLLRQENLYRRSPNG

DGEQECDKTAEECKAELLERLRARQVENGHRGPAGSDDELLQLARQLYELLVPQAI

GAKGDAQQIARKFLSPLADKDAVGGLGIAKAGNKPRWVRMREAGEPGWEEEKEKA

ETRKSADRTADVLRALADFGLKPLMRVYTDSEMSSVEWKPLRKGQAVRTWDRDM

FQQAIERMMSWESWNQRVGQEYAKLVEQKNRFEQKNFVGQEHLVHLVNQLQQDM

KEASPGLESKEQTAHYVTGRALRGSDKVFEKWGKLAPDAPFDLYDAEIKNVQRRNT

RRFGSHDLFAKLAEPEYQALWREDASFLTRYAVYNSILRKLNHAKMFATFTLPDAT

AHPIWTRFDKLGGNLHQYTFLFNEFGERRHAIRFHKLLKVENGVAREVDDVTVPISM

SEQLDNLLPRDPNEPIALYFRDYGAEQHFTGEFGGAKIQCRRDQLAHMHRRRGARD

VYLNVSVRVQSQSEARGERRPPYAAVFRLVGDNHRAFVHFDKLSDYLAEHPDDGKL

GSEGLLSGLRVMSVDLGLRTSASISVFRVARKDELKPNSKGRVPFFFPIKGNDNLVAV

HERSQLLKLPGETESKDLRAIREERQRTLRQLRTQLAYLRLLVRCGSEDVGRRERSW

AKLIEQPVDAANHMTPDWREAFENELQKLKSLHGICSDKEWMDAVYESVRRVWRH

MGKQVRDWRKDVRSGERPKIRGYAKDVVGGNSIEQIEYLERQYKFLKSWSFFGKVS

GQVIRAEKGSRFAITLREHIDHAKEDRLKKLADRIIMEALGYVYALDERGKGKWVA

KYPPCQLILLEELSEYQFNNDRPPSENNQLMQWSHRGVFQELINQAQVHDLLVGTM

YAAFSSRFDARTGAPGIRCRRVPARCTQEHNPEPFPWWLNKFVVEHTLDACPLRAD

DLIPTGEGEIFVSPFSAEEGDFHQIHADLNAAQNLQQRLWSDFDISQIRLRCDWGEVD

GELVLIPRLTGKRTADSYSNKVFYTNTGVTYYERERGKKRRKVFAQEKLSEEEAELL

VEADEAREKSVVLMRDPSGIINRGNWTRQKEFWSMVNQRIEGYLVKQIRSRVPLQD

SACENTGDI

C2c2 (uniprot.org/uniprot/P0DOC6)
>sp|P0DOC6|C2C2_LEPSD CRISPR-associated endoribonuclease C2c2 OS = *Leptotrichia shahii* (strain DSM 19757/CCUG 47503/OP 107916/JCM 16776/LB37) GN = c2c2 PE = 1 S V = 1

(SEQ ID NO: 40)

MGNLFGHKRWYEVRDKKDFKIKRKVKVKRNYDGNKYILNINENNNKEKIDNNKFIR

KYINYKKNDNILKEFTRKFHAGNILFKLKGKEGIIRIENNDDFLETEEVVLYIEAYGKS

EKLKALGITKKKIIDEAIRQGITKDDKKIEIKRQENEEEIEIDIRDEYTNKTLNDCSIILRI

IENDELETKKSIYEIFKNINMSLYKIIEKIIENETEKVFENRYYEEHLREKLLKDDKIDVI

LTNFMEIREKIKSNLEILGFVKFYLNVGGDKKKSKNKKMLVEKILNINVDLTVEDIAD

FVIKELEFWNITKRIEKVKKVNNEFLEKRRNRTYIKSYVLLDKHEKFKIERENKKDKI

```
VKFFVENIKNNSIKEKIEKILAEFKIDELIKKLEKELKKGNCDTEIFGIFKKHYKVNFDS

KKFSKKSDEEKELYKIIYRYLKGRIEKILVNEQKVRLKKMEKIEIEKILNESILSEKILK

RVKQYTLEHIMYLGKLRHNDIDMTTVNTDDFSRLHAKEELDLELITFFASTNMELNK

IFSRENINNDENIDFFGGDREKNYVLDKKILNSKIKIIRDLDFIDNKNNITNNFIRKFTKI

GTNERNRILHAISKERDLQGTQDDYNKVINIIQNLKISDEEVSKALNLDVVFKDKKNII

TKINDIKISEENNNDIKYLPSFSKVLPEILNLYRNNPKNEPFDTIETEKIVLNALIYVNKE

LYKKLILEDDLEENESKNIFLQELKKTLGNIDEIDENIIENYYKNAQISASKGNNKAIK

KYQKKVIECYIGYLRKNYEELFDFSDFKMNIQEIKKQIKDINDNKTYERITVKTSDKTI

VINDDFEYIISIFALLNSNAVINKIRNRFFATSVWLNTSEYQNIIDILDEIMQLNTLRNEC

ITENWNLNLEEFIQKMKEIEKDFDDFKIQTKKEIFNNYYEDIKNNILTEFKDDINGCDV

LEKKLEKIVIFDDETKFEIDKKSNILQDEQRKLSNINKKDLKKKVDQYIKDKDQEIKS

KILCRIIFNSDFLKKYKKEIDNLIEDMESENENKFQEIYYPKERKNELYIYKKNLFLNIG

NPNFDKIYGLISNDIKMADAKFLFNIDGKNIRKNKISEIDAILKNLNDKLNGYSKEYKE

KYIKKLKENDDFFAKNIQNKNYKSFEKDYNRVSEYKKIRDLVEFNYLNKIESYLIDIN

WKLAIQMARFERDMHYIVNGLRELGIIKLSGYNTGISRAYPKRNGSDGFYTTTAYYK

FFDEESYKKFEKICYGFGIDLSENSEINKPENESIRNYISHFYIVRNPFADYSIAEQIDRV

SNLLSYSTRYNNSTYASVFEVFKKDVNLDYDELKKKFKLIGNNDILERLMKPKKVSV

LELESYNSDYIKNLIIELLTKIENTNDTL
```

Cas9 Domains of Nucleobase Editors

In some aspects, a nucleic acid programmable DNA binding protein (napDNAbp) is a Cas9 domain. Non-limiting, exemplary Cas9 domains are provided herein. The Cas9 domain may be a nuclease active Cas9 domain, a nuclease inactive Cas9 domain, or a Cas9 nickase. In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth in SEQ ID NOs: 4-29. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any Cas9 provided herein, or to one of the amino acid sequences set forth in SEQ ID NOs: 4-29. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any Cas9 provided herein, or to any one of the amino acid sequences set forth in SEQ ID NOs: 4-29. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any Cas9 provided herein or any one of the amino acid sequences set forth in SEQ ID NOs: 4-29.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth in SEQ ID NO: 6, or a corresponding mutation in any Cas9 provided herein, such as one of the amino acid sequences provided in SEQ ID NOs: 4-26, wherein X is any amino acid change. In some embodiments, the nuclease-inactive dCas9 domain comprises a D10A mutation and a H840A mutation of the amino acid sequence set forth in SEQ ID NO: 6, or a corresponding mutation in any Cas9 provided herein, such as any one of the amino acid sequences provided in SEQ ID NOs: 4-26. As one example, a nuclease-inactive Cas9 domain comprises the amino acid sequence set forth in SEQ ID NO: 9 (Cloning vector pPlatTET-gRNA2, Accession No. BAV54124).

```
MDKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE
```

-continued

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDAIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFFKTEITLANGEIRKRPLIETNGETGEIVWDKGR

DFATVRKVLSMPQVNIVKKTEVQTGGFSKESILPKRNSDKLIARKKDWD

PKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD (SEQ ID NO: 9; see, e.g., Qi et al., "Repurposing CRISPR as an RNA-guided platform for sequence-specific control of gene expression." Cell. 2013; 152(5):1173-83, the entire contents of which are incorporated herein by reference).

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference). In some embodiments the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 7, 8, 9, or 22. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth in SEQ ID NOs: 7, 8, 9, or 22.

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840 of SEQ ID NO: 6, or a mutation in any Cas9 provided herein, such as any one of SEQ ID NOs: 4-26. For example, a Cas9 nickase may comprise the amino acid sequence as set forth in SEQ ID NO: 10, 13, 16, or 21. In some embodiments, the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10 of SEQ ID NO: 6, or a corresponding mutation in any Cas9 provided herein, such as any one of SEQ ID NOs: 4-26. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

Cas9 Domains with Reduced PAM Exclusivity

Some aspects of the disclosure provide Cas9 domains that have different PAM specificities. Typically, Cas9 proteins, such as Cas9 from *S. pyogenes* (spCas9), require a canonical NGG PAM sequence to bind a particular nucleic acid region, where the "N" in "NGG" is adenine (A), thymine (T), guanine (G), or cytosine (C), and the G is guanine. This may limit the ability to edit desired bases within a genome. In some embodiments, the base editing fusion proteins provided herein need to be positioned at a precise location, for example, where a target base is within a 4 base region (e.g., a "deamination window"), which is approximately 15 bases upstream of the PAM. See Komor, A. C., et al., "Programmable editing of a target base in genomic DNA without double-stranded DNA cleavage" *Nature* 533, 420-424 (2016), the entire contents of which are hereby incorporated by reference. In some embodiments, the deamination window is within a 2, 3, 4, 5, 6, 7, 8, 9, or 10 base region. In some embodiments, the deamination window is 5, 6, 7, 8, 9, 10, 11, 12, 13, 14, 15, 16, 17, 18, 19, 20, 21, 22, 23, 24, or 25 bases upstream of the PAM. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises the amino acid sequence SEQ ID NO: 12. In some embodiments, the SaCas9 comprises a N579X mutation of SEQ ID NO: 12, or a corresponding mutation in any of the amino acid sequences provided in SEQ ID NOs: 13-14, wherein X is any amino acid except for N. In some embodiments, the SaCas9 comprises a N579A mutation of SEQ ID NO: 12, or a corresponding mutation in any of the amino acid sequences provided in SEQ ID NOs: 13-14.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence, where N=A, T, C, or G, and R=A or G. In some embodiments, the SaCas9 domain comprises one or more of E781X, N967X, and R1014X mutation of SEQ ID NO: 12, or a corresponding mutation in any of the amino acid sequences provided in SEQ ID NOs: 13-14, wherein X is any amino acid. In some embodiments, the SaCas9 domain comprises one or more of a E781K, a N967K, and a R1014H mutation of SEQ ID NO: 12, or one or more corresponding mutation in any of the amino acid sequences provided in SEQ ID NOs: 13-14. In some embodiments, the SaCas9 domain comprises a E781K, a N967K, or a R1014H mutation of SEQ ID NO: 12, or corresponding mutations in any of the amino acid sequences provided in SEQ ID NOs: 13-14.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 12-14. In some embodiments, the Cas9 domain of any of the fusion proteins provided herein comprises the amino acid sequence of any one of SEQ ID NOs: 12-14. In some embodiments, the Cas9 domain of any of the fusion proteins provided herein consists of the amino acid sequence of any one of SEQ ID NOs: 12-14.

```
Exemplary SaCas9 sequence
                                           (SEQ ID NO: 12)
KRNYILGLDIGITSVGYGIIDYETRDVIDAGVRLFKEANVENNEGRRSK

RGARRLKRRRRHRIQRVKKLLFDYNLLTDHSELSGINTPYEARVKGLSQ

KLSEEEFSAALLHLAKRRGVHNVNEVEEDTGNELSTKEQISRNSKALEE

KYVAELQLERLKKDGEVRGSINRFKTSDYVKEAKQLLKVQKAYHQLDQS

FIDTYIDLLETRRTYYEGPGEGSPFGWKDIKEWYEMLMGHCTYFPEELR

SVKYAYNADLYNALNDLNNLVITRDENEKLEYYEKFQIIENVFKQKKKP

TLKQIAKEILVNEEDIKGYRVTSTGKPEFTNLKVYHDIKDITARKEIIE

NAELLDQIAKILTIYQSSEDIQEELTNLNSELTQEEIEQISNLKGYTGT
```

-continued

```
HNLSLKAINLILDELWHTNDNQIAIFNRLKLVPKKVDLSQQKEIPTTLV

DDFILSPVVKRSFIQSIKVINAIIKKYGLPNDIIIELAREKNSKDAQKM

INEMQKRNRQTNERIEEIIRTTGKENAKYLIEKIKLHDMQEGKCLYSLE

AIPLEDLLNNPFNYEVDHIIPRSVSFDNSFNNKVLVKQEENSKKGNRTP

FQYLSSSDSKISYETFKKHILNLAKGKGRISKTKKEYLLEERDINRFSV

QKDFINRNLVDTRYATRGLMNLLRSYFRVNNLDVKVKSINGGFTSFLRR

KWKFKKERNKGYKHHAEDALIIANADFIFKEWKKLDKAKKVMENQMFEE

KQAESMPEIETEQEYKEIFITPHQIKHIKDFKDYKYSHRVDKKPNRELI

NDTLYSTRKDDKGNTLIVNNLNGLYDKDNDKLKKLINKSPEKLLMYHHD

PQTYQKLKLIMEQYGDEKNPLYKYYEETGNYLTKYSKKDNGPVIKKIKY

YGNKLNAHLDITDDYPNSRNKVVKLSLKPYRFDVYLDNGVYKFVTVKNL

DVIKKENYYEVNSKCYEEAKKLKKISNQAEFIASFYNNDLIKINGELYR

VIGVNNDLLNRIEVNMIDITYREYLENMNDKRPPRIIKTIASKTQSIKK

YSTDILGNLYEVKSKKHPQIIKKG
```

Residue N579 of SEQ ID NO: 12, which is underlined and in bold, may be mutated (e.g., to a A579) to yield a SaCas9 nickase.

```
Exemplary SaCas9n sequence
                                           (SEQ ID NO: 13)
KRNYILGLDIGITSVGYGIIDYETRDVIDAGVRLFKEANVENNEGRRS

KRGARRLKRRRRHRIQRVKKLLFDYNLLTDHSELSGINIPYEARVKGL

SQKLSEEEFSAALLHLAKRRGVHNVNEVEEDTGNELSTKEQISRNSKA

LEEKYVAELQLERLKKDGEVRGSINRFKTSDYVKEAKQLLKVQKAYHQ

LDQSFIDTYIDLLETRRTYYEGPGEGSPFGWKDIKEWYEMLMGHCTYF

PEELRSVKYAYNADLYNALNDLNNLVITRDENEKLEYYEKFQIIENVF

KQKKKPTLKQIAKEILVNEEDIKGYRVTSTGKPEFTNLKVYHDIKDIT

ARKEIIENAELLDQIAKILTIYQSSEDIQEELTNLNSELTQEEIEQIS

NLKGYTGTHNLSLKAINLILDELWHTNDNQIAIFNRLKLVPKKVDLSQ

QKEIPTTLVDDFILSPVVKRSFIQSIKVINAIIKKYGLPNDIIIELAR

EKNSKDAQKMINEMQKRNRQTNERIEEIIRTTGKENAKYLIEKIKLHD

MQEGKCLYSLEAIPLEDLLNNPFNYEVDHIIPRSVSFDNSFNNKVLVK

QEEASKKGNRTPFQYLSSSDSKISYETFKKHILNLAKGKGRISKTKKE

YLLEERDINIRFSVQKDFINRNLVDTRYATRGLMNLLRSYFRVNNLDV

KVKSINGGFTSFLRRKWKFKKERNKGYKHHAEDALIIANADFIFKEWK

KLDKAKKVMENQMFEEKQAESMPEIETEQEYKEIFITPHQIKHIKDFK

DYKYSHRVDKKPNRELINDTLYSTRKDDKGNTLIVNNLNGLYDKDNDK

LKKLINKSPEKLLMYHHDPQTYQKLKLIMEQYGDEKNPLYKYYEETGN

YLTKYSKKDNGPVIKKIKYYGNKLNAHLDITDDYPNSRNKVVKLSLKP

YRFDVYLDNGVYKFVTVKNLDVIKKENYYEVNSKCYEEAKKLKKISNQ

AEFIASFYNNDLIKINGELYRVIGVNNDLLNRIEVNMIDITYREYLEN

MNDKRPPRIIKTIASKTQSIKKYSTDILGNLYEVKSKKHPQIIKKG.
```

Residue A579 of SEQ ID NO: 13, which can be mutated from N579 of SEQ ID NO: 12 to yield a SaCas9 nickase, is underlined and in bold.

Exemplary SaKKH Cas9

(SEQ ID NO: 14)

KRNYILGLDIGITSVGYGIIDYETRDVIDAGVRLFKEANVENNEGRR

SKRGARRLKRRRRHRIQRVKKLLFDYNLLTDHSELSGINPYEARVKG

LSQKLSEEEFSAALLHLAKRRGVHNVNEVEEDTGNELSTKEQISRNS

KALEEKYVAELQLERLKKDGEVRGSINRFKTSDYVKEAKQLLKVQKA

YHQLDQSFIDTYIDLLETRRTYYEGPGEGSPFGWKDIKEWYEMLMGH

CTYFPEELRSVKYAYNADLYNALNDLNNLVITRDENEKLEYYEKFQI

IENVFKQKKKPTLKQIAKEILVNEEDIKGYRVTSTGKPEFTNLKVYH

DIKDITARKEIIENAELLDQIAKILTIYQSSEDIQEELTNLNSELTQ

EEIEQISNLKGYTGTHNLSLKAINLILDELWHTNDNQIAIFNRLKLV

PKKVDLSQQKEIPTTLVDDFILSPVVKRSFIQSIKVINAIIKKYGLP

NDIIIELAREKNSKDAQKMINEMQKRNRQTNERIEEIIRTTGKENAK

YLIEKIKLHDMQEGKCLYSLEAIPLEDLLNNPFNYEVDHIIPRSVSF

DNSFNNKVLVKQEEASKKGNRTPFQYLSSSDSKISYETFKKHILNLA

KGKGRISKTKKEYLLEERDINIRFSVQKDFINRNLVDTRYATRGLMN

LLRSYFRVNNLDVKVKSINGGFTSFLRRKWKFKKERNKGYKHHAEDA

LIIANADFIFKEWKKLDKAKKVMENQMFEEKQAESMPEIETEQEYKE

IFITPHQIKHIKDFKDYKYSHRVDKKPNR*K*LINDTLYSTRKDDKGNT

LIVNNLNGLYDKDNDKLKKLINKSPEKLLMYHHDPQTYQKLKLIMEQ

YGDEKNPLYKYYEETGNYLTKYSKKDNGPVIKKIKYYGNKLNAHLDI

TDDYPNSRNKVVKLSLKPYRFDVYLDNGVYKFVTVKNLDVIKKENYY

EVNSKCYEEAKKLKKISNQAEFIASFY*K*NDLIKINGELYRVIGVNND

LLNRIEVNMIDITYREYLENMNDKRPP*H*IIKTIASKTQSIKKYSTDI

LGNLYEVKSKKHPQIIKKG.

Residue A579 of SEQ ID NO: 14, which can be mutated from N579 of SEQ ID NO: 12 to yield a SaCas9 nickase, is underlined and in bold. Residues K781, K967, and H1014 of SEQ ID NO: 14, which can be mutated from E781, N967, and R1014 of SEQ ID NO: 12 to yield a SaKKH Cas9 are underlined and in italics.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises the amino acid sequence SEQ ID NO: 15. In some embodiments, the SpCas9 comprises a D9X mutation of SEQ ID NO: 15, or a corresponding mutation in any Cas9, such as any of the amino acid sequences provided in SEQ ID NOs: 4-26, wherein X is any amino acid except for D. In some embodiments, the SpCas9 comprises a D9A mutation of SEQ ID NO: 15, or a corresponding mutation in any Cas9 provided herein, such as any of the amino acid sequences provided in SEQ ID NOs: 4-26. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having a NGG, a NGA, or a NGCG PAM sequence. In some embodiments, the SpCas9 domain comprises one or more of a D1134X, a R1334X, and a T1336X mutation of SEQ ID NO: 15, or a corresponding mutation in any Cas9 provided herein, such as any of the amino acid sequences provided in SEQ ID NOs: 4-26, wherein X is any amino acid. In some embodiments, the SpCas9 domain comprises one or more of a D1134E, R1334Q, and T1336R mutation of SEQ ID NO: 15, or a corresponding mutation in any Cas9 provided herein, such as any of the amino acid sequences provided in SEQ ID NOs: 4-26. In some embodiments, the SpCas9 domain comprises a D1134E, a R1334Q, and a T1336R mutation of SEQ ID NO: 15, or corresponding mutations in any Cas9 provided herein, such as any of the amino acid sequences provided in SEQ ID NOs: 4-26. In some embodiments, the SpCas9 domain comprises one or more of a D1134X, a R1334X, and a T1336X mutation of SEQ ID NO: 15, or a corresponding mutation in any Cas9 provided herein, such as any of the amino acid sequences provided in SEQ ID NOs: 4-26, wherein X is any amino acid. In some embodiments, the SpCas9 domain comprises one or more of a D1134V, a R1334Q, and a T1336R mutation of SEQ ID NO: 15, or a corresponding mutation in any Cas9 provided herein, such as any of the amino acid sequences provided in SEQ ID NOs: 4-26. In some embodiments, the SpCas9 domain comprises a D1134V, a R1334Q, and a T1336R mutation of SEQ ID NO: 15, or corresponding mutations in any Cas9 provided herein, such as any of the amino acid sequences provided in SEQ ID NOs: 4-26. In some embodiments, the SpCas9 domain comprises one or more of a D1134X, a G1217X, a R1334X, and a T1336X mutation of SEQ ID NO: 15, or a corresponding mutation in any Cas9 provided herein, such as any one of the amino acid sequences provided in SEQ ID NOs: 4-26, wherein X is any amino acid. In some embodiments, the SpCas9 domain comprises one or more of a D1134V, a G1217R, a R1334Q, and a T1336R mutation of SEQ ID NO: 15, or a corresponding mutation in any Cas9 provided herin, such as any of the amino acid sequences provided in SEQ ID NOs: 4-26. In some embodiments, the SpCas9 domain comprises a D1134V, a G1217R, a R1334Q, and a T1336R mutation of SEQ ID NO: 15, or corresponding mutations in any Cas9 provided herein, such as any one of the amino acid sequences provided in SEQ ID NOs: 4-26.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 15-19. In some embodiments, the Cas9 domain of any of the fusion proteins provided herein comprises the amino acid sequence of any one of SEQ ID NOs: 15-19. In some embodiments, the Cas9 domain of any of the fusion proteins provided herein consists of the amino acid sequence of any one of SEQ ID NOs: 15-19.

Exemplary SpCas9

(SEQ ID NO: 15)

DKKYSIGLDIGTNSVGWAVITDEYKVPSKKFKVLGNTDRHSIKKNLIGALL

FDSGETAEATRLKRTARRRYTRRKNRICYLQEIFSNEMAKVDDSFFHRLEESFLVEED

KKHERHPIFGNIVDEVAYHEKYPTIYHLRKKLVDSTDKADLRLIYLALAHMIKFRGH

FLIEGDLNPDNSDVDKLFIQLVQTYNQLFEENPINASGVDAKAILSARLSKSRRLENLI

AQLPGEKKNGLFGNLIALSLGLTPNFKSNFDLAEDAKLQLSKDTYDDDLDNLLAQIG

DQYADLFLAAKNLSDAILLSDILRVNTEITKAPLSASMIKRYDEHHQDLTLLKALVRQ

QLPEKYKEIFFDQSKNGYAGYIDGGASQEEFYKFIKPILEKMDGTEELLVKLNREDLL

RKQRTFDNGSIPHQIHLGELHAILRRQEDFYPFLKDNREKIEKILTFRIPYYVGPLARG

NSRFAWMTRKSEETITPWNFEEVVDKGASAQSFIERMTNFDKNLPNEKVLPKHSLLY

EYFTVYNELTKVKYVTEGMRKPAFLSGEQKKAIVDLLFKTNRKVTVKQLKEDYFKK

IECFDSVETSGVEDRFNASLGTYHDLLKIIKDKDFLDNEENEDILEDIVLTLTLFEDREM

IEERLKTYAHLFDDKVMKQLKRRRYTGWGRLSRKLINGIRDKQSGKTILDFLKSDGF

ANRNFMQLIHDDSLTFKEDIQKAQVSGQGDSLHEHIANLAGSPAIKKGILQTVKVVD

ELVKVMGRHKPENIVIEMARENQTTQKGQKNSRERMKRIEEGIKELGSQILKEHPVE

NTQLQNEKLYLYYLQNGRDMYVDQELDINRLSDYDVDHIVPQSFLKDDSIDNKVLT

RSDKNRGKSDNVPSEEVVKKMKNYWRQLLNAKLITQRKFDNLTKAERGGLSELDK

AGFIKRQLVETRQITKHVAQILDSRMNTKYDENDKLIREVKVITLKSKLVSDFRKDFQ

FYKVREINNYHHAHDAYLNAVVGTALIKKYPKLESEFVYGDYKVYDVRKMIAKSEQ

EIGKATAKYFFYSNIMNFFKTEITLANGEIRKRPLIETNGETGEIVWDKGRDFATVRK

VLSMPQVNIVKKTEVQTGGFSKESILPKRNSDKLIARKKDWDPKKYGGFDSPTVAYS

VLVVAKVEKGKSKKLKSVKELLGITIMERSSFEKNPIDFLEAKGYKEVKKDLIIKLPK

YSLFELENGRKRMLASAGELQKGNELALPSKYVNFLYLASHYEKLKGSPEDNEQKQ

LFVEQHKHYLDEIIEQISEFSKRVILADANLDKVLSAYNKHRDKPIREQAENIIHLFTLT

NLGAPAAFKYFDTTIDRKRYTSTKEVLDATLIHQSITGLYETRIDLSQLGGD

Exemplary SpCas9n (SEQ ID NO: 16)

DKKYSIGLAIGTNSVGWAVITDEYKVPSKKFKVLGNTDRHSIKKNLIGALL

FDSGETAEATRLKRTARRRYTRRKNRICYLQEIFSNEMAKVDDSFFHRLEESFLVEED

KKHERHPIFGNIVDEVAYHEKYPTIYHLRKKLVDSTDKADLRLIYLALAHMIKFRGH

FLIEGDLNPDNSDVDKLFIQLVQTYNQLFEENPINASGVDAKAILSARLSKSRRLENLI

AQLPGEKKNGLFGNLIALSLGLTPNFKSNFDLAEDAKLQLSKDTYDDDLDNLLAQIG

DQYADLFLAAKNLSDAILLSDILRVNTEITKAPLSASMIKRYDEHHQDLTLLKALVRQ

QLPEKYKEIFFDQSKNGYAGYIDGGASQEEFYKFIKPILEKMDGTEELLVKLNREDLL

RKQRTFDNGSIPHQIHLGELHAILRRQEDFYPFLKDNREKIEKILTFRIPYYVGPLARG

NSRFAWMTRKSEETITPWNFEEVVDKGASAQSFIERMTNFDKNLPNEKVLPKHSLLY

EYFTVYNELTKVKYVTEGMRKPAFLSGEQKKAIVDLLFKTNRKVTVKQLKEDYFKK

IECFDSVETSGVEDRFNASLGTYHDLLKIIKDKDFLDNEENEDILEDIVLTLTLFEDREM

IEERLKTYAHLFDDKVMKQLKRRRYTGWGRLSRKLINGIRDKQSGKTILDFLKSDGF

ANRNFMQLIHDDSLTFKEDIQKAQVSGQGDSLHEHIANLAGSPAIKKGILQTVKVVD

ELVKVMGRHKPENIVIEMARENQTTQKGQKNSRERMKRIEEGIKELGSQILKEHPVE

NTQLQNEKLYLYYLQNGRDMYVDQELDINRLSDYDVDHIVPQSFLKDDSIDNKVLT

-continued

RSDKNRGKSDNVPSEEVVKKMKNYWRQLLNAKLITQRKFDNLTKAERGGLSELDK

AGFIKRQLVETRQITKHVAQILDSRMNTKYDENDKLIREVKVITLKSKLVSDFRKDFQ

FYKVREINNYHHAHDAYLNAVVGTALIKKYPKLESEFVYGDYKVYDVRKMIAKSEQ

EIGKATAKYFFYSNIMNFFKTEITLANGEIRKRPLIETNGETGEIVWDKGRDFATVRK

VLSMPQVNIVKKTEVQTGGFSKESILPKRNSDKLIARKKDWDPKKYGGFDSPTVAYS

VLVVAKVEKGKSKKLKSVKELLGITIMERSSFEKNPIDFLEAKGYKEVKKDLIIKLPK

YSLFELENGRKRMLASAGELQKGNELALPSKYVNFLYLASHYEKLKGSPEDNEQKQ

LFVEQHKHYLDEIIEQISEFSKRVILADANLDKVLSAYNKHRDKPIREQAENIIHLFTLT

NLGAPAAFKYFDTTIDRKRYTSTKEVLDATLIHQSITGLYETRIDLSQLGGD

Exemplary SpEQR Cas9

(SEQ ID NO: 17)

DKKYSIGLAIGTNSVGWAVITDEYKVPSKKFKVLGNTDRHSIKKNLIGALL

FDSGETAEATRLKRTARRRYTRRKNRICYLQEIFSNEMAKVDDSFFHRLEESFLVEED

KKHERHPIFGNIVDEVAYHEKYPTIYHLRKKLVDSTDKADLRLIYLALAHMIKFRGH

FLIEGDLNPDNSDVDKLFIQLVQTYNQLFEENPINASGVDAKAILSARLSKSRRLENLI

AQLPGEKKNGLFGNLIALSLGLTPNFKSNFDLAEDAKLQLSKDTYDDDLDNLLAQIG

DQYADLFLAAKNLSDAILLSDILRVNTEITKAPLSASMIKRYDEHHQDLTLLKALVRQ

QLPEKYKEIFFDQSKNGYAGYIDGGASQEEFYKFIKPILEKMDGTEELLVKLNREDLL

RKQRTFDNGSIPHQIHLGELHAILRRQEDFYPFLKDNREKIEKILTFRIPYYVGPLARG

NSRFAWMTRKSEETITPWNFEEVVDKGASAQSFIERMTNFDKNLPNEKVLPKHSLLY

EYFTVYNELTKVKYVTEGMRKPAFLSGEQKKAIVDLLFKTNRKVTVKQLKEDYFKK

IECFDSVETSGVEDRFNASLGTYHDLLKIIKDKDFLDNEENEDILEDIVLTLTLFEDREM

IEERLKTYAHLFDDKVMKQLKRRRYTGWGRLSRKLINGIRDKQSGKTILDFLKSDGF

ANRNFMQLIHDDSLTFKEDIQKAQVSGQGDSLHEHIANLAGSPAIKKGILQTVKVVD

ELVKVMGRHKPENIVIEMARENQTTQKGQKNSRERMKRIEEGIKELGSQILKEHPVE

NTQLQNEKLYLYYLQNGRDMYVDQELDINRLSDYDVDHIVPQSFLKDDSIDNKVLT

RSDKNRGKSDNVPSEEVVKKMKNYWRQLLNAKLITQRKFDNLTKAERGGLSELDK

AGFIKRQLVETRQITKHVAQILDSRMNTKYDENDKLIREVKVITLKSKLVSDFRKDFQ

FYKVREINNYHHAHDAYLNAVVGTALIKKYPKLESEFVYGDYKVYDVRKMIAKSEQ

EIGKATAKYFFYSNIMNFFKTEITLANGEIRKRPLIETNGETGEIVWDKGRDFATVRK

VLSMPQVNIVKKTEVQTGGFSKESILPKRNSDKLIARKKDWDPKKYGGFESPTVAYS

VLVVAKVEKGKSKKLKSVKELLGITIMERSSFEKNPIDFLEAKGYKEVKKDLIIKLPK

YSLFELENGRKRMLASAGELQKGNELALPSKYVNFLYLASHYEKLKGSPEDNEQKQ

LFVEQHKHYLDEIIEQISEFSKRVILADANLDKVLSAYNKHRDKPIREQAENIIHLFTLT

NLGAPAAFKYFDTTIDRKQYRSTKEVLDATLIHQSITGLYETRIDLSQLGGD

Residues E1134, Q1334, and R1336 of SEQ ID NO: 17, which can be mutated from D1134, R1334, and T1336 of SEQ ID NO: 15 to yield a SpEQR Cas9, are underlined and in bold.

Exemplary SpVQR Cas9

(SEQ ID NO: 18)

DKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEK

ILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKT

YAHLFDDKVMKQLKRRRYTGWGRLSRKLINGIRDKQSGKTILDFLKSDG

FANRNFMQLIHDDSLTFKEDIQKAQVSGQGDSLHEHIANLAGSPAIKKG

ILQTVKVVDELVKVMGRHKPENIVIEMARENQTTQKGQKNSRERMKRIE

EGIKELGSQILKEHPVENTQLQNEKLYLYYLQNGRDMYVDQELDINRLS

DYDVDHIVPQSFLKDDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFVSPTVAYSVLVVAKVEKGKSKKLKSVKELLGITIMERSSFEKN

PIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKQYRSTKEVLDATLIHQSITGLYETRIDLSQLGGD

Residues V1134, Q1334, and R1336 of SEQ ID NO: 18, which can be mutated from D1134, R1334, and T1336 of SEQ ID NO: 15 to yield a SpVQR Cas9, are underlined and in bold.

Exemplary SpVRER Cas9

(SEQ ID NO: 19)

DKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSF

FHRLEESFLVEEDKKHERHPIFGNIVDEVAYHEKYPTIYHLRKKLVDS

TDKADLRLIYLALAHMIKFRGHFLIEGDLNPDNSDVDKLFIQLVQTYN

-continued

QLFEENPINASGVDAKAILSARLSKSRRLENLIAQLPGEKKNGLFGNL

IALSLGLTPNFKSNFDLAEDAKLQLSKDTYDDDLDNLLAQIGDQYADL

FLAAKNLSDAILLSDILRVNTEITKAPLSASMIKRYDEHHQDLTLLKA

LVRQQLPEKYKEIFFDQSKNGYAGYIDGGASQEEFYKFIKPILEKMDG

TEELLVKLNREDLLRKQRTFDNGSIPHQIHLGELHAILRRQEDFYPFL

KDNREKIEKILTFRIPYYVGPLARGNSRFAWMTRKSEETITPWNFEEV

VDKGASAQSFIERMTNFDKNLPNEKVLPKHSLLYEYFTVYNELTKVKY

VTEGMRKPAFLSGEQKKAIVDLLFKTNRKVTVKQLKEDYFKKIECFDS

VEISGVEDRFNASLGTYHDLLKIIKDKDFLDNEENEDILEDIVLTLTL

FEDREMIEERLKTYAHLFDDKVMKQLKRRRYTGWGRLSRKLINGIRDK

QSGKTILDFLKSDGFANRNFMQLIHDDSLTFKEDIQKAQVSGQGDSLH

EHIANLAGSPAIKKGILQTVKVVDELVKVMGRHKPENIVIEMARENQT

TQKGQKNSRERMKRIEEGIKELGSQILKEHPVENTQLQNEKLYLYYLQ

NGRDMYVDQELDINRLSDYDVDHIVPQSFLKDDSIDNKVLTRSDKNRG

KSDNVPSEEVVKKMKNYWRQLLNAKLITQRKFDNLTKAERGGLSELDK

AGFIKRQLVETRQITKHVAQILDSRMNTKYDENDKLIREVKVITLKSK

LVSDFRKDFQFYKVREINNYHHAHDAYLNAVVGTALIKKYPKLESEFV

YGDYKVYDVRKMIAKSEQEIGKATAKYFFYSNIMNFFKTEITLANGEI

RKRPLIETNGETGEIVWDKGRDFATVRKVLSMPQVNIVKKTEVQTGGF

SKESILPKRNSDKLIARKKDWDPKKYGGFVSPTVAYSVLVVAKVEKGK

SKKLKSVKELLGITIMERSSFEKNPIDFLEAKGYKEVKKDLIIKLPKY

SLFELENGRKRMLASARELQKGNELALPSKYVNFLYLASHYEKLKGSP

EDNEQKQLFVEQHKHYLDEIIEQISEFSKRVILADANLDKVLSAYNKH

RDKPIREQAENIIHLFTLTNLGAPAAFKYFDTTIDRKEYRSTKEVLDA

TLIHQSITGLYETRIDLSQLGGD

Residues V1134, R1217, Q1334, and R1336 of SEQ ID NO: 19, which can be mutated from D1134, G1217, R1334, and T1336 of SEQ ID NO: 15 to yield a SpVRER Cas9, are underlined and in bold.

High Fidelity Cas9 Domains

Some aspects of the disclosure provide high fidelity Cas9 domains of the nucleobase editors provided herein. In some embodiments, high fidelity Cas9 domains are engineered Cas9 domains comprising one or more mutations that decrease electrostatic interactions between the Cas9 domain and the sugar-phosphate backbone of DNA, as compared to a corresponding wild-type Cas9 domain. Without wishing to be bound by any particular theory, high fidelity Cas9 domains that have decreased electrostatic interactions with the sugar-phosphate backbone of DNA may have less off-target effects. In some embodiments, the Cas9 domain (e.g., a wild type Cas9 domain) comprises one or more mutations that decrease the association between the Cas9 domain and the sugar-phosphate backbone of DNA. In some embodiments, a Cas9 domain comprises one or more mutations that decreases the association between the Cas9 domain and the sugar-phosphate backbone of DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, or more.

In some embodiments, any of the Cas9 fusion proteins provided herein comprise one or more of N497X, R661X, Q695X, and/or Q926X mutation of the amino acid sequence provided in SEQ ID NO: 6, or corresponding mutation(s) in any Cas9 provided herein, such as any of the amino acid sequences provided in SEQ ID NOs: 4-26, wherein X is any amino acid. In some embodiments, any of the Cas9 fusion proteins provided herein comprise one or more of N497A, R661A, Q695A, and/or Q926A mutation of the amino acid sequence provided in SEQ ID NO: 6, or a corresponding mutation in any Cas9 provided herein, such as any of the amino acid sequences provided in SEQ ID NOs: 4-26. In some embodiments, the Cas9 domain comprises a D10A mutation of the amino acid sequence provided in SEQ ID NO: 6, or a corresponding mutation in any Cas9 provided herein, such as any of the amino acid sequences provided in SEQ ID NOs: 4-26. In some embodiments, the Cas9 domain (e.g., of any of the fusion proteins provided herein) comprises the amino acid sequence as set forth in SEQ ID NO: 20. In some embodiments, the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to SEQ ID NO: 20. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." *Nature* 529, 490-495 (2016); and Slaymaker, I. M., et al. "Rationally engineered Cas9 nucleases with improved specificity." *Science* 351, 84-88 (2015); the entire contents of each are incorporated herein by reference.

It should be appreciated that any of the base editors provided herein, for example, any of the C to G base editors provided herein, may be converted into high fidelity base editors by modifying the Cas9 domain as described herein to generate high fidelity base editors, for example, a high fidelity C to G base editor. In some embodiments, the high fidelity Cas9 domain is a dCas9 domain. In some embodiments, the high fidelity Cas9 domain is a nCas9 domain.

High Fidelity Cas9 domain where mutations relative to Cas9 of SEQ ID NO: 6 are shown in bold and underlines (SEQ ID NO: 20)

DKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSF

FHRLEESFLVEEDKKHERHPIFGNIVDEVAYHEKYPTIYHLRKKLVDS

TDKADLRLIYLALAHMIKFRGHFLIEGDLNPDNSDVDKLFIQLVQTYN

QLFEENPINASGVDAKAILSARLSKSRRLENLIAQLPGEKKNGLFGNL

IALSLGLTPNFKSNFDLAEDAKLQLSKDTYDDDLDNLLAQIGDQYADL

FLAAKNLSDAILLSDILRVNTEITKAPLSASMIKRYDEHHQDLTLLKA

LVRQQLPEKYKEIFFDQSKNGYAGYIDGGASQEEFYKFIKPILEKMDG

TEELLVKLNREDLLRKQRTFDNGSIPHQIHLGELHAILRRQEDFYPFL

KDNREKIEKILTFRIPYYVGPLARGNSRFAWMTRKSEETITPWNFEEV

VDKGASAQSFIERMTAFDKNLPNEKVLPKHSLLYEYFTVYNELTKVKY

VTEGMRKPAFLSGEQKKAIVDLLFKTNRKVTVKQLKEDYFKKIECFDS

VEISGVEDRFNASLGTYHDLLKIIKDKDFLDNEENEDILEDIVLTLTL

-continued

FEDREMIEERLKTYAHLFDDKVMKQLKRRRYTGWGALSRKLINGIRDK

QSGKTILDFLKSDGFANRNFMALIHDDSLTFKEDIQKAQVSGQGDSLH

EHIANLAGSPAIKKGILQTVKVVDELVKVMGRHKPENIVIEMARENQT

TQKGQKNSRERMKRIEEGIKELGSQILKEHPVENTQLQNEKLYLYYLQ

NGRDMYVDQELDINRLSDYDVDHIVPQSFLKDDSIDNKVLTRSDKNRG

KSDNVPSEEVVKKMKNYWRQLLNAKLITQRKFDNLTKAERGGLSELDK

AGFIKRQLVETRAITKHVAQILDSRMNTKYDENDKLIREVKVITLKSK

LVSDFRKDFQFYKVREINNYHHAHDAYLNAVVGTALIKKYPKLESEFV

YGDYKVYDVRKMIAKSEQEIGKATAKYFFYSNIMNFFKTEITLANGEI

RKRPLIETNGETGEIVWDKGRDFATVRKVLSMPQVNIVKKTEVQTGGF

SKESILPKRNSDKLIARKKDWDPKKYGGFDSPTVAYSVLVVAKVEKGK

SKKLKSVKELLGITIMERSSFEKNPIDFLEAKGYKEVKKDLIIKLPKY

SLFELENGRKRMLASAGELQKGNELALPSKYVNFLYLASHYEKLKGSP

EDNEQKQLFVEQHKHYLDEIIEQISEFSKRVILADANLDKVLSAYNKH

RDKPIREQAENIIHLFTLTNLGAPAAFKYFDTTIDRKRYTSTKEVLDA

TLIHQSITGLYETRIDLSQLGGD

The disclosure also provides fragments of napDNAbps, such as truncations of any of the napDNAbps provided herein. In some embodiments, the napDNAbp is an N-terminal truncation, where one or more amino acids are absent from the N-terminus of the napDNAbp. In some embodiments, the napDNAbp is absent 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, or 50 amino acids from the N-terminus of the napDNAbp. For example, the N-terminal truncation of the napDNAbp may be an N-terminal truncation of any napDNAbp provided herein, such as any one of the napDNAbps provided in any one of SEQ ID NOs: 4-40. In some embodiments, the napDNAbp is a C-terminal truncation, where one or more amino acids are absent from the C-terminus of the napDNAbp. In some embodiments, the napDNAbp is absent 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, or 50 amino acids from the C-terminus of the napDNAbp. For example, the C-terminal truncation of the napDNAbp may be a C-terminal truncation of any napDNAbp provided herein, such as any one of the NAPs provided in any one of SEQ ID NOs: 4-40.

In some embodiments, any of the napDNAbps provided herein have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to any napDNAbp provided herein, such as any one of the napDNAbps provided in SEQ ID NOs: 4-40.

Uracil Binding Proteins (UBP)

A uracil binding protein, or UBP, refers to a protein that is capable of binding to uracil. In some embodiments, the uracil binding protein is a uracil modifying enzyme. In some embodiments, the uracil binding protein is a uracil base excision enzyme. In some embodiments, the uracil binding protein is a uracil DNA glycosylase (UDG). In some embodiments, a uracil binding protein binds uracil with an affinity that is at least 1%, 2%, 3%, 5%, 10%, 15%, 20%, 30%, 40%, 50%, 60%, 70%, 80%, 90%, or at least 95% of the affinity that a wild type UDG (e.g., a human UDG) binds to uracil. In some embodiments, the uracil binding protein may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to wild type uracil binding protein such as a wild type UDG (e.g., a human UDG) binds to uracil.

In some embodiments, the UBP is a uracil modifying enzyme. In some embodiments, the UBP is a uracil base excision enzyme. In some embodiments, the UBP is a uracil DNA glycosylase. In some embodiments, the UBP is any of the uracil binding proteins provided herein. For example, the UBP may be a UDG, a UdgX, a UdgX*, a UdgX_On, or a SMUG1. In some embodiments, the UBP comprises an amino acid sequence that is at least 75%, 80%, 85%, 90%, 95%, 96%, 97%, 98%, 99%, or 99.5% identical to a uracil binding protein, a uracil base excision enzyme or a uracil DNA glycosylase (UDG) enzyme. In some embodiments, the UBP comprises an amino acid sequence that is at least 75%, 80%, 85%, 90%, 95%, 96%, 97%, 98%, 99%, or 99.5% identical to any of the uracil binding proteins provided herein, for example, any of the UBP and UBP variants provided below. In some embodiments, the UBP comprises an amino acid sequence that is at least 75%, 80%, 85%, 90%, 95%, 96%, 97%, 98%, 99%, or 99.5% identical to any one of SEQ ID NOs: 48-53. In some embodiments, the UBP comprises the amino acid sequence of any one of SEQ ID NOs: 48-53. In some embodiments, the uracil binding protein has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to any UBP provided herein, such as any one of SEQ ID NOs: 48-53.

The disclosure also provides fragments of UBPs, such as truncations of any of the UBPs provided herein. In some embodiments, the UBP is an N-terminal truncation, where one or more amino acids are absent from the N-terminus of the UBP. In some embodiments, the UBP is absent 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, or 50 amino acids from the N-terminus of the UBP. For example, the N-terminal truncation of the UBP may be an N-terminal truncation of any UBP provided herein, such as any one of the UBPs provided in any one of SEQ ID NOs: 48-53. In some embodiments, the UBP is a C-terminal truncation, where one or more amino acids are absent from the C-terminus of the UBP. In some embodiments, the UBP is absent 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, or 50 amino acids from the C-terminus of the UBP. For example, the C-terminal truncation of the UBP may be a C-terminal truncation of any UBP provided herein, such as any one of the UBPs provided in any one of SEQ ID NOs: 48-53.

It should be appreciated that other UBPs would be apparent to the skilled artisan and are within the scope of this disclosure. For example UBPs have been described previously in Sang et al., "A Unique Uracil-DNA binding protein of the uracil DNA glycosylase superfamily," *Nucleic Acids Research*, Vol. 43, No. 17 2015; the entire contents of which are hereby incorporated by reference.

```
UDG
                                                  (SEQ ID NO: 48)
MIGQKTLYSFFSPSPARKRHAPSPEPAVQGTGVAGVPEESGDAAAIPAKKAPAGQEE

PGTPPSSPLSAEQLDRIQRNKAAALLRLAARNVPVGFGESWKKHLSGEFGKPYFIKL

MGFVAEERKHYTVYPPPHQVFTWTQMCDIKDVKVVILGQDPYHGPNQAHGLCFSV

QRPVPPPPSLENIYKELSTDIEDFVHPGHGDLSGWAKQGVLLLNAVLTVRAHQANSH

KERGWEQFTDAVVSWLNQNSNGLVFLLWGSYAQKKGSAIDRKRHHVLQTAHPSPL

SVYRGFFGCRHFSKTNELLQKSGKKPIDWKEL

UdgX
                                                  (SEQ ID NO: 49)
MAGAQDFVPHTADLAELAAAAGECRGCGLYRDATQAVFGAGGRSARIMMIGEQPG

DKEDLAGLPFVGPAGRLLDRALEAADIDRDALYVTNAVKHFKFTRAAGGKRRIHKT

PSRTEVVACRPWLIAEMTSVEPDVVVLLGATAAKALLGNDFRVTQHRGEVLHVDDV

PGDPALVATVHPSSLLRGPKEERESAFAGLVDDLRVAADVRP

UdgX* (R107S)
                                                  (SEQ ID NO: 50)
MAGAQDFVPHTADLAELAAAAGECRGCGLYRDATQAVFGAGGRSARIMMIGEQPG

DKEDLAGLPFVGPAGRLLDRALEAADIDRDALYVTNAVKHFKFTRAAGGKRSIHKT

PSRTEVVACRPWLIAEMTSVEPDVVVLLGATAAKALLGNDFRVTQHRGEVLHVDDV

PGDPALVATVHPSSLLRGPKEERESAFAGLVDDLRVAADVRP
```

-continued

UdgX_On (H109S)

(SEQ ID NO: 51)

MAGAQDFVPHTADLAELAAAAGECRGCGLYRDATQAVFGAGGRSARIMMIGEQPG

DKEDLAGLPFVGPAGRLLDRALEAADIDRDALYVTNAVKHFKFTRAAGGKRRISKT

PSRTEVVACRPWLIAEMTSVEPDVVVLLGATAAKALLGNDFRVTQHRGEVLHVDDV

PGDPALVATVHPSSLLRGPKEERESAFAGLVDDLRVAADVRP

Rev7

(SEQ ID NO: 52)

MTTLTRQDLNFGQVVADVLCEFLEVAVHLILYVREVYPVGIFQKRKKYNVPVQMSC

HPELNQYIQDTLHCVKPLLEKNDVEKVVVVILDKEHRPVEKFVFEITQPPLLSISSDSL

LSHVEQLLRAFILKISVCDAVLDHNPPGCTFTVLVHTREAATRNMEKIQVIKDFPWIL

ADEQDVHMHDPRLIPLKTMTSDILKMQLYVEERAHKGS

Smug1

(SEQ ID NO: 53)

MPQAFLLGSIHEPAGALMEPQPCPGSLAESFLEEELRLNAELSQLQFSEPVGIIYNPVE

YAWEPHRNYVTRYCQGPKEVLFLGMNPGPFGMAQTGVPFGEVSMVRDWLGIVGPV

LTPPQEHPKRPVLGLECPQSEVSGARFWGFFRNLCGQPEVFFHHCFVHNLCPLLFLAP

SGRNLTPAELPAKQREQLLGICDAALCRQVQLLGVRLVVGVGRLAEQRARRALAGL

MPEVQVEGLLHPSPRNPQANKGWEAVAKERLNELGLLPLLLK

Nucleic Acid Polymerases (NAP)

A nucleic acid polymerase, or NAP, refers to an enzyme that synthesizes nucleic acid molecules (e.g., DNA and RNA) from nucleotides (e.g., deoxyribonucleotides and ribonucleotides). In some embodiments, the NAP is a DNA polymerase. In some embodiments, the NAP is a translesion polymerase. Translesion polymerases play a role in mutagenesis, for example, by restarting replication forks or filling in gaps that remain in the genome due to the presence of DNA lesions. Exemplary translesion polymerases include, without limitation, Pol Beta, Pol Lambda, Pol Eta, Pol Mu, Pol Iota, Pol Kappa, Pol Alpha, Pol Delta, Pol Gamma, and Pol Nu.

In some embodiments, the NAP is a eukaryotic nucleic acid polymerase. In some embodiments, the NAP is a DNA polymerase. In some embodiments, the NAP has translesion polymerase activity. In some embodiments, the NAP is a translesion DNA polymerase. In some embodiments, the NAP is a Rev7, Rev1 complex, polymerase iota, polymerase kappa, or polymerase eta. In some embodiments, the NAP is a eukaryotic polymerase alpha, beta, gamma, delta, epsilon, gamma, eta, iota, kappa, lambda, mu, or nu. In some embodiments, the NAP comprises an amino acid sequence that is at least 75%, 80%, 85%, 90%, 95%, 96%, 97%, 98%, 99%, or 99.5% identical to a naturally occurring nucleic acid polymerase (e.g., a translesion DNA polymerase). In some embodiments, the NAP comprises an amino acid sequence that is at least 75%, 80%, 85%, 90%, 95%, 96%, 97%, 98%, 99%, or 99.5% identical to any of the nucleic acid polymerases provided herein, e.g., below. For example, the NAP may comprise an amino acid sequence that is at least 75%, 80%, 85%, 90%, 95%, 96%, 97%, 98%, 99%, or 99.5% identical to any one of SEQ ID NOs: 54-64. In some embodiments, the NAP comprises the amino acid sequence of any one of SEQ ID NOs: 54-64. It should be appreciated that other NAPs would be apparent to the skilled artisan and are within the scope of this disclosure. In some embodiments, the NAP comprises the amino acid sequence of any one of SEQ ID NOs: 54-64. In some embodiments, the nucleic acid polymerase has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to any NAP provided herein, such as any one of SEQ ID NOs: 54-64.

The disclosure also provides fragments of NAPs, such as truncations of any of the NAPs provided herein. In some embodiments, the NAP is an N-terminal truncation, where one or more amino acids are absent from the N-terminus of the NAP. In some embodiments, the NAP is absent 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, or 50 amino acids from the N-terminus of the NAP. For example, the N-terminal truncation of the NAP may be an N-terminal truncation of any NAP provided herein, such as any one of the NAPs provided in any one of SEQ ID NOs: 54-64. In some embodiments, the NAP is a C-terminal truncation, where one or more amino acids are absent from the C-terminus of the NAP. In some embodiments, the NAP is absent 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, or 50 amino acids from the C-terminus of the NAP. For example, the C-terminal truncation of the NAP may be a C-terminal truncation of any NAP provided herein, such as any one of the NAPs provided in any one of SEQ ID NOs: 54-64.

Pol Beta (SEQ ID NO: 54)

MSKRKAPQETLNGGITDMLTELANFEKNVSQAIHKYNAYRKAASVIAKYPHKIKSG

AEAKKLPGVGTKIAEKIDEFLATGKLRKLEKIRQDDTSSSINFLTRVSGIGPSAARKFV

DEGIKTLEDLRKNEDKLNHHQRIGLKYFGDFEKRIPREEMLQMQDIVLNEVKKVDSE

YIATVCGSFRRGAESSGDMDVLLTHPSFTSESTKQPKLLHQVVEQLQKVHFITDTLSK

GETKFMGVCQLPSKNDEKEYPHRRIDIRLIPKDQYYCGVLYFTGSDIFNKNMRAHAL

EKGFTINEYTIRPLGVTGVAGEPLPVDSEKDIFDYIQWKYREPKDRSE

Pol Lambda (SEQ ID NO: 55)

MDPRGILKAFPKRQKIHADASSKVLAKIPRREEGEEAEEWLSSLRAHVVRTGIGRAR

AELFEKQIVQHGGQLCPAQGPGVTHIVVDEGMDYERALRLLRLPQLPPGAQLVKSA

WLSLCLQERRLVDVAGFSIFIPSRYLDHPQPSKAEQDASIPPGTHEALLQTALSPPPPP

TRPVSPPQKAKEAPNTQAQPISDDEASDGEETQVSAADLEALISGHYPTSLEGDCEPS

PAPAVLDKWVCAQPSSQKATNHNLHITEKLEVLAKAYSVQGDKWRALGYAKAINA

LKSFHKPVTSYQEACSIPGIGKRMAEKIIEILESGHLRKLDHISESVPVLELFSNIWGAG

TKTAQMWYQQGFRSLEDIRSQASLTTQQAIGLKHYSDFLERMPREEATEIEQTVQKA

AQAFNSGLLCVACGSYRRGKATCGDVDVLITHPDGRSHRGIFSRLLDSLRQEGFLTD

DLVSQEENGQQQKYLGVCRLPGPGRRHRRLDIIVVPYSEFACALLYFTGSAHFNRSM

RALAKTKGMSLSEHALSTAVVRNTHGCKVGPGRVLPTPTEKDVFRLLGLPYREPAE

RDW

Pol Eta (SEQ ID NO: 56)

MATGQDRVVALVDMDCFFVQVEQRQNPHLRNKPCAVVQYKSWKGGGIIAVSYEA

RAFGVTRSMWADDAKKLCPDLLLAQVRESRGKANLTKYREASVEVMEEVISRFAVIE

RASIDEAYVDLTSAVQERLQKLQGQPISADLLPSTYIEGLPQGPTTAEETVQKEGMRK

QGLFQWLDSLQIDNLTSPDLQLTVGAVIVEEMRAAIERETGFQCSAGISHNKVLAKL

ACGLNKPNRQTLVSHGSVPQLFSQMPIRK1RSLGGKLGASVIEILGIEYMGELTQFTES

QLQSHFGEKNGSWLYAMCRGIEHDPVKPRQLPKTIGCSKNFPGKTALATREQVQWW

LLQLAQELEERLTKDRNDNDRVATQLVVSIRVQGDKRLSSLRRCCALTRYDAHKMS

HDAFTVIKNCNTSGIQTEWSPPLTMLFLCATKFSASAPSSSTDITSFLSSDPSSLPKVPV

TSSEAKTQGSGPAVTATKKATTSLESFFQKAAERQKVKEASLSSLTAPTQAPMSNSPS

KPSLPFQTSQSTGTEPFFKQKSLLLKQKQLNNSSVSSPQQNPWSNCKALPNSLPTEYP

GCVPVCEGVSKLEESSKATPAEMDLAHNSQSMHASSASKSVLEVTQKATPNPSLLA

AEDQVPCEKCGSLVPVWDMPEHMDYHFALELQKSFLQPHSSNPQVVSAVSHQGKR

NPKSPLACTNKRPRPEGMQTLESFFKPLTH

Pol Mu (SEQ ID NO: 57)

MLPKRRRARVGSPSGDAASSTPPSTRFPGVAIYLVEPRMGRSRRAFLTGLARSKGFR

VLDACSSEATHVVMEETSAEEAVSWQERRMAAAPPGCTPPALLDISWLTESLGAGQ

PVPVECRHRLEVAGPRKGPLSPAWMPAYACQRPTPLTHHNTGLSEALEILAEAAGFE

GSEGRLLTFCRAASVLKALPSPVTTLSQLQGLPHFGEHSSRVVQELLEHGVCEEVER

VRRSERYQTMKLFTQIFGVGVKTADRWYREGLRTLDDLREQPQKLTQQQKAGLQH

HQDLSTPVLRSDVDALQQVVEEAVGQALPGATVTLTGGFRRGKLQGHDVDFLITHP

KEGQEAGLLPRVMCRLQDQGLILYHQHQHSCCESPTRLAQQSHMDAFERSFCIFRLP

-continued

QPPGAAVGGSTRPCPSWKAVRVDLVVAPVSQFPFALLGWTGSKLFQRELRRFSRKE

KGLWLNSHGLFDPEQKTFFQAASEEDIFRHLGLEYLPPEQRNA

Pol Iota (SEQ ID NO: 58)

MEKLGVEPEEEGGGDDDEEDAEAWAMELADVGAAASSQGVHDQVLPTPNASSRVI

VHVDLDCFYAQVEMISNPELKDKPLGVQQKYLVVTCNYEARKLGVKKLMNVRDA

KEKCPQLVLVNGEDLTRYREMSYKVTELLEEFSPVVERLGFDENFVDLTEMVEKRL

QQLQSDELSAVTVSGHVYNNQSINLLDVLHIRLLVGSQIAAEMREAMYNQLGLTGC

AGVASNKLLAKLVSGVFKPNQQTVLLPESCQHLIHSLNHIKEIPGIGYKTAKCLEALG

INSVRDLQTFSPKILEKELGISVAQRIQKLSFGEDNSPVILSGPPQSFSEEDSFKKCSSEV

EAKNKIEELLASLLNRVCQDGRKPHTVRLIIRRYSSEKHYGRESRQCPIPSHVIQKLGT

GNYDVMTPMVDILMKLFRNMVNVKMPFHLTLLSVCFCNLKALNTAKKGLIDYYLM

PSLSTTSRSGKHSFKMKDTHMEDFPKDKETNRDFLPSGRIESTRTRESPLDTTNFSKE

KDINEFPLCSLPEGVDQEVFKQLPVDIQEEILSGKSREKFQGKGSVSCPLHASRGVLSF

FSKKQMQDIPINPRDHLSSSKQVSSVSPCEPGTSGFNSSSSSYMSSQKDYSYYLDNRL

KDERISQGPKEPQGFHFTNSNPAVSAFHSFPNLQSEQLFSRNHTTDSHKQTVATDSHE

GLTENREPDSVDEKITFPSDIDPQVFYELPEAVQKELLAEWKRAGSDFHIGHK

Pol Kappa (SEQ ID NO: 59)

MDSTKEKCDSYKDDLLLRMGLNDNKAGMEGLDKEKINKIIMEATKGSRFYGNELK

KEKQVNQRIENMMQQKAQITSQQLRKAQLQVDRFAMELEQSRNLSNTIVHIDMDAF

YAAVEMRDNPELKDKPIAVGSMSMLSTSNYHARRFGVRAAMPGFIAKRLCPQLIIVP

PNFDKYRAVSKEVKEILADYDPNFMAMSLDEAYLNITKHLEERQNWPEDKRRYFIK

MGSSVENDNPGKEVNKLSEHERSISPLLFEESPSDVQPPGDPFQVNFEEQNNPQILQN

SVVFGTSAQEVVKEIRFRIEQKTTLTASAGIAPNTMLAKVCSDKNKPNGQYQILPNRQ

AVMDFIKDLPIRKVSGIGKVTEKMLKALGIITCTELYQQRALLSLLFSETSWHYFLHIS

LGLGSTHLTRDGERKSMSVERTFSEINKAEEQYSLCQELCSELAQDLQKERLKGRTV

TIKLKNVNFEVKTRASTVSSVVSTAEEIFAIAKELLKTEIDADFPHPLRLRLMGVRISSF

PNEEDRKHQQRSIIGFLQAGNQALSATECTLEKTDKDKFVKPLEMSHKKSFFDKKRS

ERKWSHQDTFKCEAVNKQSFQTSQPFQVLKKKMNENLEISENSDDCQILTCPVCFRA

QGCISLEALNKHVDECLDGPSISENFKMFSCSHVSATKVNKKENVPASSLCEKQDYE

AHPKIKEISSVDCIALVDTIDNSSKAESIDALSNKHSKEECSSLPSKSFNIEHCHQNSSS

TVSLENEDVGSFRQEYRQPYLCEVKTGQALVCPVCNVEQKTSDLTLFNVHVDVCLN

KSFIQELRKDKFNPVNQPKESSRSTGSSSGVQKAVTRTKRPGLMTKYSTSKKIKPNNP

KHTLDIFFK

Pol Alpha (SEQ ID NO: 60)

MAPVHGDDCEIGASALSDSGSFVSSRARREKKSKKGRQEALERLKKAKAGEKYKYE

VEDFTGVYEEVDEEQYSKLVQARQDDDWIVDDDGIGYVEDGREIFDDDLEDDALDA

DEKGKDGKARNKDKRNVKKLAVTKPNNIKSMFIACAGKKTADKAVDLSKDGLLGD

ILQDLNTETPQITPPPVMILKKKRSIGASPNPFSVHTATAVPSGKIASPVSRKEPPLTPV

PLKRAEFAGDDVQVESTEEEQESGAMEFEDGDFDEPMEVEEVDLEPMAAKAWDKE

SEPAEEVKQEADSGKGTVSYLGSFLPDVSCWDIDQEGDSSFSVQEVQVDSSHLPLVK

-continued

GADEEQVFHFYWLDAYEDQYNQPGVVFLFGKVWIESAETHVSCCVMVKNIERTLYF

LPREMKIDLNTGKETGTPISMKDVYEEFDEKIATKYKIMKFKSKPVEKNYAFEIPDVP

EKSEYLEVKYSAEMPQLPQDLKGETFSHVFGTNTSSLELFLMNRKIKGPCWLEVKSP

QLLNQPVSWCKVEAMALKPDLVNVIKDVSPPPLVVMAFSMKTMQNAKNHQNEIIA

MAALVHHSFALDKAAPKPPFQSHFCVVSKPKDCIFPYAFKEVIEKKNVKVEVAATER

TLLGFFLAKVHKIDPDIIVGHNIYGFELEVLLQRINVCKAPHWSKIGRLKRSNMPKLG

GRSGFGERNATCGRMICDVEISAKELIRCKSYHLSELVQQILKTERVVIPMENIQNMY

SESSQLLYLLEHTWKDAKFILQIMCELNVLPLALQITNIAGNIMSRTLMGGRSERNEF

LLLHAFYENNYIVPDKQIFRKPQQKLGDEDEEIDGDTNKYKKGRKKAAYAGGLVLD

PKVGFYDKFILLLDFNSLYPSIIQEFNICFTTVQRVASEAQKVTEDGEQEQIPELPDPSL

EMGILPREIRKLVERRKQVKQLMKQQDLNPDLILQYDIRQKALKLTANSMYGCLGFS

YSRFYAKPLAALVTYKGREILMHTKEMVQKMNLEVIYGDTDSIMINTNSTNLEEVFK

LGNKVKSEVNKLYKLLEIDIDGVFKSLLLLKKKKYAALVVEPTSDGNYVTKQELKG

LDIVRRDWCDLAKDTGNFVIGQILSDQSRDTIVENIQKRLIEIGENVLNGSVPVSQFEI

NKALTKDPQDYPDKKSLPHVHVALWINSQGGRKVKAGDTVSYVICQDGSNLTASQR

AYAPEQLQKQDNLTIDTQYYLAQQIHPVVARICEPIDGIDAVLIATWLGLDPTQFRVH

HYHKDEENDALLGGPAQLTDEEKYRDCERFKCPCPTCGTENIYDNVFDGSGTDMEP

SLYRCSNIDCKASPLTFTVQLSNKLIMDIRRFIKKYYDGWLICEEPTCRNRTRHLPLQF

SRTGPLCPACMKATLQPEYSDKSLYTQLCFYRYIFDAECALEKLTTDHEKDKLKKQF

FTPKVLQDYRKLKNTAEQFLSRSGYSEVNLSKLFAGCAVKS

Pol Delta (SEQ ID NO: 61)

MDGKRRPGPGPGVPPKRARGGLWDDDDAPRPSQFEEDLALMEEMEAEHRLQEQEE

EELQSVLEGVADGQVPPSAIDPRWLRPTPPALDPQTEPLIFQQLEIDHYVGPAQPVPG

GPPPSHGSVPVLRAFGVTDEGFSVCCHIHGFAPYFYTPAPPGFGPEHMGDLQRELNL

AISRDSRGGRELTGPAVLAVELCSRESMFGYHGHGPSPFLRITVALPRLVAPARRLLE

QGIRVAGLGTPSFAPYEANVDFEIRFMVDTDIVGCNWLELPAGKYALRLKEKATQCQ

LEADVLWSDVVSHPPEGPWQRIAPLRVLSFDIECAGRKGIFPEPERDPVIQICSLGLRW

GEPEPFLRLALTLRPCAPILGAKVQSYEKEEDLLQAWSTFIRIMDPDVITGYNIQNFDL

PYLISRAQTLKVQTFPFLGRVAGLCSNIRDSSFQSKQTGRRDTKVVSMVGRVQMDM

LQVLLREYKLRSYTLNAVSFHFLGEQKEDVQHSIITDLQNGNDQTRRRLAVYCLKDA

YLPLRLLERLMVLVNAVEMARVTGVPLSYLLSRGQQVKVVSQLLRQAMHEGLLMP

VVKSEGGEDYTGATVIEPLKGYYDVPIATLDFSSLYPSIMMAHNLCYTTLLRPGTAQ

KLGLTEDQFIRTPTGDEFVKTSVRKGLLPQILENLLSARKRAKAELAKETDPLRRQVL

DGRQLALKVSANSVYGFTGAQVGKLPCLEISQSVTGFGRQMIEKTKQLVESKYTVEN

GYSTSAKVVYGDTDSVMCRFGVSSVAEAMALGREAADWVSGHFPSPIRLEFEKVYF

PYLLISKKRYAGLLFSSRPDAHDRMDCKGLEAVRRDNCPLVANLVTASLRRLLIDRD

PEGAVAHAQDVISDLLCNRIDISQLVITKELTRAASDYAGKQAHVELAERMRKRDPG

SAPSLGDRVPYVIISAAKGVAAYMKSEDPLFVLEHSLPIDTQYYLEQQLAKPLLRIFEP

ILGEGRAEAVLLRGDHTRCKTVLTGKVGGLLAFAKRRNCCIGCRTVLSHQGAVCEF

CQPRESELYQKEVSHLNALEERFSRLWTQCQRCQGSLHEDVICTSRDCPIFYMRKKV

RKDLEDQEQLLRRFGPPGPEAW

-continued

Pol Gamma (SEQ ID NO: 62)

MSRLLWRKVAGATVGPGPVPAPGRWVSSSVPASDPSDGQRRRQQQQQQQQQQQQ

QPQQPQVLSSEGGQLRHNPLDIQMLSRGLHEQIFGQGGEMPGEAAVRRSVEHLQKH

GLWGQPAVPLPDVELRLPPLYGDNLDQHFRLLAQKQSLPYLEAANLLLQAQLPPKPP

AWAWAEGWTRYGPEGEAVPVAIPEERALVFDVEVCLAEGTCPTLAVAISPSAWYSW

CSQRLVEERYSWTSQLSPADLIPLEVPTGASSPTQRDWQEQLVVGHNVSFDRAHIRE

QYLIQGSRMRFLDTMSMHMAISGLSSFORSLWIAAKQGKHKVOPPTKQGQKSQRKA

RRGPAISSWDWLDISSVNSLAEVHRLYVGGPPLEKEPRELFVKGTMKDIRENFQDLM

QYCAQDVWATHEVFQQQLPLFLERCPHPVTLAGMLEMGVSYLPVNQNWERYLAEA

QGTYEELQREMKKSLMDLANDACQLLSGERYKEDPWLWDLEWDLQEFKQKKAKK

VKKEPATASKLPIEGAGAPGDPMDQEDLGPCSEEEEFQQDVMARACLQKLKGTTEL

LPKRPQHLPGHPGWYRKLCPRLDDPAWTPGPSLLSLQMRVTPKLMALTWDGFPLHY

SERHGWGYLVPGRRDNLAKLPTGTTLESAGVVCPYRAIESLYRKHCLEQGKQQLMP

QEAGLAEEFLLTDNSAIWQTVEELDYLEVEAEAKMENLRAAVPGQPLALTARGGPK

DTQPSYHHGNGPYNDVDIPGCWFFKLPHKDGNSCNVGSPFAKDFLPKMEDGTLQAG

PGGASGPRALEINKMISFWRNAHKRISSQMVVWLPRSALPRAVIRHPDYDEEGLYGA

ILPQVVTAGTITRRAVEPTWLTASNARPDRVGSELKAMVQAPPGYTLVGADVDSQE

LWIAAVLGDAHFAGMHGCTAFGWMTLQGRKSRGTDLHSKTATTVGISREHAKIFNY

GRIYGAGQPFAERLLMQFNHRLTQQEAAEKAQQMYAATKGLRWYRLSDEGEWLV

RELNLPVDRTEGGWISLQDLRKVQRETARKSQWKKWEVVAERAWKGGTESEMFN

KLESIATSDIPRTPVLGCCISRALEPSAVQEEFMTSRVNWVVQSSAVDYLHLMLVAM

KWLFEEFAIDGRFCISIHDEVRYLVREEDRYRAALALQITNLLTRCMFAYKLGLNDLP

QSVAFFSAVDIDRCLRKEVTMDCKTPSNPTGMERRYGIPQGEALDIYQIIELTKGSLE

KRSQPGP

Pol Nu (SEQ ID NO: 63)

MENYEALVGFDLCNTPLSSVAQKIMSAMHSGDLVDSKTWGKSTETMEVINKSSVKY

SVQLEDRKTQSPEKKDLKSLRSQTSRGSAKLSPQSFSVRLTDQLSADOKOKSISSLTL

SSCLIPQYNQEASVLQKKGHKRKHFLMENINNENKGSINLKRKHITYNNLSEKTSKO

MALEEDTDDAEGYLNSGNSGALKKHFCDIRHLDDWAKSQUEMLKQAAALVITym

YTDGSTQLGADQTPVSSVRGIVVLVKRQAEGGHGCPDAPACGPVLEGFVSDDPCIYI

QIEHSAIWDQEQEAHQQFARNVLFQTMKCKCPVICFNAKDFVRIVLQFFGNDGSWK

HVADFIGLDPRIAAWLIDPSDATPSFEDLVEKYCEKSITVKVNSTYGNSSRNIVNQNV

RENLKTLYRLTMDLCSKLKDYGLWQLFRTLELPLIPILAVMESHAIQVNKEEMEKTS

ALLGARLKELEQEAHFVAGERFLITSNNQLREILFGKLKLHLLSQRNSLPRTGLQKYP

STSEAVLNALRDLHPLPKIILEYRQVHKIKSTFVDGLLACMKKGSISSTWNQTGTVTG

RLSAKHPNIQGISKHPIQITTPKNFKGKEDKILTISPRAMFVSSKGHTFLAADFSQIELRI

LTHLSGDPELLKLFQESERDDVFSTLTSQWKDVPVEQVTHADREQTKKVVYAVVYG

AGKERLAACLGVPIQEAAQFLESFLQKYKKIKDFARAAIAQCHQTGCVVSIMGRRRP

LPRIHAHDQQLRAQAERQAVNFVVQGSAADLCKLAMIHVFTAVAASHTLTARLVAQ

```
IHDELLFEVEDPQIPECAALVRRTMESLEQVQALELQLQVPLKVSLSAGRSWGHLVP

LQEAWGPPPGPCRTESPSNSLAAPGSPASTQPPPLHFSPSFCL

Rev1
                                                     (SEQ ID NO: 64)
MRRGGWRKRAENDGWETWGGYMAAKVQKLEEQFRSDAAMQKDGTSSTIFSGVAI

YVNGYTDPSAEELRKLMMLHGGQYHVYYSRSKTTHIIATNLPNAKIKELKGEKVIRP

EWIVESIKAGRLLSYIPYQLYTKQSSVQKGLSFNPVCRPEDPLPGPSNIAKQLNNRVN

HIVKKIETENEVKVNGMNSWNEEDENNDFSFVDLEQTSPGRKQNGIPHPRGSTAIFN

GHTPSSNGALKTQDCLVPMVNSVASRLSPAFSQEEDKAEKSSTDFRDCTLQQLQQST

RNTDALRNPHRTNSFSLSPLHSNTKINGAHHSTVQGPSSTKSTSSVSTFSKAAPSVPSK

PSDCNFISNFYSHSRLHHISMWKCELTEFVNTLQRQSNGIFPGREKLKKMKTGRSALV

VTDTGDMSVLNSPRHQSCIMHVDMDCFFVSVGIRNRPDLKGKPVAVTSNRGTGRAP

LRPGANPQLEWQYYQNKILKGKAADIPDSSLWENPDSAQANGIDSVLSRAEIASCSY

EARQLGIKNGMFFGHAKQLCPNLQAVPYDFHAYKEVAQTLYETLASYTHNIEAVSC

DEALVDITEILAETKLTPDEFANAVRMEIKDQTKCAASVGIGSNILLARMATRKAKPD

GQYHLKPEEVDDFIRGQLVTNLPGVGHSMESKLASLGIKTCGDLQYMTMAKLQKEF

GPKTGQMLYRFCRGLDDRPVRTEKERKSVSAEINYGIRFTQPKEAEAFLLSLSEEIQR

RLEATGMKGKRLTLKIMVRKPGAPVETAKFGGHGICDNIARTVTLDQATDNAKIIGK

AMLNMFHTMKLNISDMRGVGIHVNQLVPTNLNPSTCPSRPSVQSSHFPSGSYSVRDV

FQVQKAKKSTEEEHKEVFRAAVDLEISSASRTCTFLPPFPAHLPTSPDTNKAESSGKW

NGLHTPVSVQSRLNLSIEVPSPSQLDQSVLEALPPDLREQVEQVCAVQQAESHGDKK

KEPVNGCNTGILPQPVGTVLLQIPEPQESNSDAGINLIALPAFSQVDPEVFAALPAELQ

RELKAAYDQRQRQGENSTHQQSASASVPKNPLLHLKAAVKEKKRNKKKKTIGSPKR

IQSPLNNKLLNSPAKTLPGACGSPQKLIDGFLKHEGPPAEKPLEELSASTSGVPGLSSL

QSDPAGCVRPPAPNLAGAVEFNDVKTLLREWITTISDPMEEDILQVVKYCTDLIEEKD

LEKLDLVIKYMKRLMQQSVESVWNMAFDFILDNVQVVLQQTYGSTLKVT
```

Base Excision Enzymes (BEE)

A base excision enzyme, or BEE, refers to a protein that is capable of removing a base (e.g., A, T, C, G, or U) from a nucleic acid molecule (e.g., DNA or RNA). In some embodiments, a BEE is capable of removing a cytosine from DNA. In some embodiments, a BEE is capable of removing a thymine from DNA. Exemplary BEEs include, without limitation UDG Tyr147Ala, and UDG Asn204Asp as described in Sang et al., "A Unique Uracil-DNA binding protein of the uracil DNA glycosylase superfamily," *Nucleic Acids Research*, Vol. 43, No. 17 2015; the entire contents of which are hereby incorporated by reference.

In some embodiments, the base excision enzyme (BEE) is a cytosine, thymine, adenine, guanine, or uracil base excision enzyme. In some embodiments, the base excision enzyme (BEE) is a cytosine base excision enzyme. In some embodiments, the BEE is a thymine base excision enzyme. In some embodiments, the base excision enzyme comprises an amino acid sequence that is at least 75%, 80%, 85%, 90%, 95%, 96%, 97%, 98%, 99%, or 99.5% identical to a naturally-occurring BEE. In some embodiments, the base excision enzyme comprises an amino acid sequence that is at least 75%, 80%, 85%, 90%, 95%, 96%, 97%, 98%, 99%, or 99.5% identical to any of the BEEs provided herein, e.g., UDG (Tyr147A1a), or UDG (Asn204Asp), below. In some embodiments, the base excision enzyme comprises an amino acid sequence that is at least 75%, 80%, 85%, 90%, 95%, 96%, 97%, 98%, 99%, or 99.5% identical to any one of SEQ ID NOs: 65-66. In some embodiments, the base excision enzyme comprises the amino acid sequence of any one of SEQ ID NOs: 65-66. In some embodiments, the base excision enzyme has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to any BEE provided herein, such as any one of SEQ ID NOs: 65-66.

The disclosure also provides fragments of BEEs, such as truncations of any of the BEEs provided herein. In some embodiments, the BEE is an N-terminal truncation, where one or more amino acids are absent from the N-terminus of the BEE. In some embodiments, the BEE is absent 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, or 50 amino acids from the N-terminus of the BEE. For example, the N-terminal truncation of the BEE may be an N-terminal truncation of any BEE provided herein, such as any one of the BEEs provided in any one of SEQ ID NOs: 65-66. In some embodiments, the BEE is a C-terminal truncation, where one or more amino acids are absent from the C-terminus of the BEE. In some embodiments, the BEE is absent 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, or 50 amino acids from the C-terminus of the BEE. For example, the C-terminal truncation of the BEE may be a C-terminal truncation of any BEE provided herein, such as any one of the BEEs provided in any one of SEQ ID NOs: 65-66.

It should be appreciated that other BEEs would be apparent to the skilled artisan and are within the scope of this disclosure. For example BEEs have been described previously in Sang et al., "A Unique Uracil-DNA binding protein of the uracil DNA glycosylase superfamily," *Nucleic Acids Research*, Vol. 43, No. 17 2015; the entire contents of which are hereby incorporated by reference.

UDG (Tyr147Ala)-The mutated residue is indicated by bold and underlining.

(SEQ ID NO: 65)

MIGQKTLYSFFSPSPARKRHAPSPEPAVQGTGVAGVPEESGDAAAIPAKK

APAGQEEPGTPPSSPLSAEQLDRIQRNKAAALLRLAARNVPVGFGESWKK

HLSGEFGKPYFIKLMGFVAEERKHYTVYPPPHQVFTWTQMCDIKDVKVVI

LGQDPAHGPNQAHGLCFSVQRPVPPPPSLENIYKELSTDIEDFVHPGHGD

LSGWAKQGVLLLNAVLTVRAHQANSHKERGWEQFTDAVVSWLNQNSNGLV

FLLWGSYAQKKGSAIDRKRHHVLQTAHPSPLSVYRGFFGCRHFSKTNELL

QKSGKKPIDWKEL

UDG (Asn204Asp)-The mutated residue is indicated by bold and underlining.

(SEQ ID NO: 66)

MIGQKTLYSFFSPSPARKRHAPSPEPAVQGTGVAGVPEESGDAAAIPAKK

APAGQEEPGTPPSSPLSAEQLDRIQRNKAAALLRLAARNVPVGFGESWKK

HLSGEFGKPYFIKLMGFVAEERKHYTVYPPPHQVFTWTQMCDIKDVKVVI

LGQDPYHGPNQAHGLCFSVQRPVPPPPSLENIYKELSTDIEDFVHPGHGD

LSGWAKQGVLLLDAVLTVRAHQANSHKERGWEQFTDAVVSWLNQNSNGLV

FLLWGSYAQKKGSAIDRKRHHVLQTAHPSPLSVYRGFFGCRHFSKTNELL

QKSGKKPIDWKEL

Deaminase Domains

In some embodiments, any of the fusion proteins or base editors provided herein comprise a cytidine deaminase domain. In some embodiments, the cytidine deaminase domain can catalyze a C to U base change. In some embodiments, the cytidine deaminase domain is an apolipoprotein B mRNA-editing complex (APOBEC) family deaminase. In some embodiments, the cytidine deaminase domain is an APOBEC1 deaminase. In some embodiments, the cytidine deaminase domain is an APOBEC2 deaminase. In some embodiments, the cytidine deaminase domain is an APOBEC3 deaminase. In some embodiments, the cytidine deaminase domain is an APOBEC3A deaminase. In some embodiments, the cytidine deaminase domain is an APOBEC3B deaminase. In some embodiments, the cytidine deaminase domain is an APOBEC3C deaminase. In some embodiments, the cytidine deaminase domain is an APOBEC3D deaminase. In some embodiments, the cytidine deaminase domain is an APOBEC3E deaminase. In some embodiments, the cytidine deaminase domain is an APOBEC3F deaminase. In some embodiments, the cytidine deaminase domain is an APOBEC3G deaminase. In some embodiments, the cytidine deaminase domain is an APOBEC3H deaminase. In some embodiments, the cytidine deaminase domain is an APOBEC4 deaminase. In some embodiments, the cytidine deaminase domain is an activation-induced deaminase (AID). In some embodiments, the cytidine deaminase domain is a vertebrate deaminase. In some embodiments, the cytidine deaminase domain is an invertebrate deaminase. In some embodiments, the cytidine deaminase domain is a human, chimpanzee, gorilla, monkey, cow, dog, rat, or mouse deaminase. In some embodiments, the cytidine deaminase domain is a human deaminase. In some embodiments, the cytidine deaminase domain is a rat deaminase, e.g., rAPOBEC1. In some embodiments, the cytidine deaminase domain is a *Petromyzon marinus* cytidine deaminase 1 (pmCDA1). In some embodiments, the cytidine deaminase domain is a human APOBEC3G (SEQ ID NO: 77). In some embodiments, the cytidine deaminase domain is a fragment of the human APOBEC3G (SEQ ID NO: 100). In some embodiments, the cytidine deaminase domain is a human APOBEC3G variant comprising a D316R_D317R mutation (SEQ ID NO: 99). In some embodiments, the cytidine deaminase domain is a frantment of the human APOBEC3G and comprising mutations corresponding to the D316R_D317R mutations in SEQ ID NO: 77 (SEQ ID NO: 101).

In some embodiments, the cytidine deaminase domain is at least 80%, at least 85%, at least 90%, at least 92%, at least 95%, at least 96%, at least 97%, at least 98%, at least 99%, or at least 99.5% identical to a naturally-occurring cytidine deaminase. In some embodiments, the cytidine deaminase domain is at least 80%, at least 85%, at least 90%, at least 92%, at least 95%, at least 96%, at least 97%, at least 98%, at least 99%, or at least 99.5% identical to any of the cytidine deaminases provided herein. In some embodiments, the cytidine deaminase domain is at least 80%, at least 85%, at least 90%, at least 92%, at least 95%, at least 96%, at least 97%, at least 98%, at least 99%, or at least 99.5% identical to the deaminase domain of any one of SEQ ID NOs: 67-101. In some embodiments, the nucleic acid editing domain comprises the amino acid sequence of any one of SEQ ID NOs: 67-101. In some embodiments, the cytidine deaminase domain has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to any cytidine deaminase domain provided herein, such as any one of SEQ ID NOs: 67-101.

The disclosure also provides fragments of cytidine deaminase domains, such as truncations of any of the cytidine deaminase domains provided herein. In some embodiments, the cytidine deaminase domain is an N-terminal truncation, where one or more amino acids are absent from the N-terminus of the cytidine deaminase domain. In some embodiments, the cytidine deaminase domain is absent 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, or 50 amino acids from the N-terminus of the cytidine deaminase domain. For example, the N-terminal truncation of the cytidine deaminase domain may be an N-terminal truncation of any cytidine deaminase domain provided herein, such as any one of the cytidine deaminase domains provided in any one of SEQ ID NOs: 67-101. In some embodiments, the cytidine deaminase domain is a C-terminal truncation, where one or more amino acids are absent from the C-terminus of the cytidine deaminase domain. In some embodiments, the cytidine deaminase domain is absent 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, or 50 amino acids from the C-terminus of the cytidine deaminase domain. For example, the C-terminal truncation of the cytidine deaminase domain may be a C-terminal truncation of any cytidine deaminase domain provided herein, such as any one of the cytidine deaminase domains provided in any one of SEQ ID NOs: 67-101.

Some exemplary cytidine deaminase domains include, without limitation, those provided below. It should be understood that, in some embodiments, the active domain of the respective sequence can be used, e.g., the domain without a localizing signal (nuclear localization sequence, without nuclear export signal, cytoplasmic localizing signal).

Human AID: MDSLLMNRRKFLYQFKNVRWAKGRRETYLC YVVKRRDSATSFSLDFGYLRNKNGC HVELLFLRYISDWDLDPGRCYRVTWFTSWSPCYDCARHVADFLRGNPNLSLRIFTAR LYFCEDRKAEPEGLRRLHRAGVQIAIMTFKDYFYCWN TFVENHERTFKAWEGLHEN SVRLSRQLRRILLP LYEVDDLRDAFRTLGL (SEQ ID NO: 67) (underline: nuclear localization sequence; double underline: nuclear export signal)

Human AID:

(SEQ ID NO: 67)

MDSLLMNRRKFLYQFKNVRWAKGRRETYLCYVVKRRDSATSFSLDFGYLRNKNGC

HVELLFLRYISDWDLDPGRCYRVTWFTSWSPCYDCARHVADFLRGNPNLSLRIFTAR

LYFCEDRKAEPEGLRRLHRAGVQIAIMTFKDYFYCWNTFVENHERTFKAWEGLHEN

SVRLSRQLRRILLPLYEVDDLRDAFRTLGL (underline: nuclear localization sequence; double underline: nuclear export signal)

Mouse AID:

(SEQ ID NO: 68)

MDSLLMKQKKFLYHFKNVRWAKGRHETYLCYVVKRRDSATSCSLDFGHLRNKSGC

HVELLFLRYISDWDLDPGRCYRVTWFTSWSPCYDCARHVAEFLRWNPNLSLRIFTAR

LYFCEDRKAEPEGLRRLHRAGVQIGIMTFKDYFYCWNTFVENRERTFKAWEGLHEN

SVRLTRQLRRILLPLYEVDDLRDAFRMLGF (underline: nuclear localization sequence; double underline: nuclear export signal)

Dog AID:

(SEQ ID NO: 69)

MDSLLMKQRKFLYHFKNVRWAKGRHETYLCYVVKRRDSATSFSLDFGHLRNKSGC

HVELLFLRYISDWDLDPGRCYRVTWFTSWSPCYDCARHVADFLRGYPNLSLRIFAAR

LYFCEDRKAEPEGLRRLHRAGVQIAIMTFKDYFYCWNTFVENREKTFKAWEGLHEN

SVRLSRQLRRILLPLYEVDDLRDAFRTLGL (underline: nuclear localization sequence; double underline: nuclear export signal)

Bovine AID:

(SEQ ID NO: 70)

MDSLLKKQRQFLYQFKNVRWAKGRHETYLCYVVKRRDSPTSFSLDFGHLRNKAGC

HVELLFLRYISDWDLDPGRCYRVTWFTSWSPCYDCARHVADFLRGYPNLSLRIFTAR

LYFCDKERKAEPEGLRRLHRAGVQIAIMTFKDYFYCWNTFVENHERTFKAWEGLHE

NSVRLSRQLRRILLPLYEVDDLRDAFRTLGL (underline: nuclear localization sequence; double underline: nuclear export signal)

Rat AID (SEQ ID NO: 71)

MAVGSKPKAALVGPHWERERIWCFLCSTGLGTQQTGQTSRWLRPAATQDPVSPPRS

LLMKQRKFLYHFKNVRWAKGRHETYLCYVVKRRDSATSFSLDFGYLRNKSGCHVE

LLFLRYISDWDLDPGRCYRVTWFTSWSPCYDCARHVADFLRGNPNLSLRIFTARLTG

-continued

WGALPAGLMSPARPSDYFYCWNTFVENHERTFKAWEGLHENSVRLSRRLRRILLPL

YEVDDLRDAFRTLGL (underline: nuclear localization sequence; double underline: nuclear export signal)

Mouse APOBEC-3:

(SEQ ID NO: 72)

MGPFCLGCSHRKCYSPIRNLISQETFKFHFKNLGYAKGRKDTFLCYEVTRKDCDSPV

SLHHGVFKNKDNI*HAEICFLYWFHDKVLKVLSPREEFKITWYMSWSPCFEC*AEQIVRFL

ATHHNLSLDIFSSRLYNVQDPETQQNLCRLVQEGAQVAAMDLYEFKKCWKKFVDN

GGRRFRPWKRLLTNFRYQDSKLQEILRPCYIPVPSSSSSTLSNICLTKGLPETRFCVEG

RRMDPLSEEEFYSQFYNQRVKHLCYYHRMKPYLCYQLEQFNGQAPLKGCLLSEKGK

Q*HAEILFLDKIRSMELSQVTITCYLTWSPCPNC*AWQLAAFKRDRPDLILHIYTSRLYFHW

KRPFQKGLCSLWQSGILVDVMDLPQFTDCWTNFVNPKRPFWPWKGLEIISRRTQRRL

RRIKESWGLQDLVNDFGNLQLGPPMS (italic: nucleic acid editing domain)

Rat APOBEC-3:

(SEQ ID NO: 73)

MGPFCLGCSHRKCYSPIRNLISQETFKFHFKNLRYAIDRKDTFLCYEVTRKDCDSPVS

LHHGVFKNKDNI*HAEICFLYWFHDKVLKVLSPREEFKITWYMSWSPCFEC*AEQVLRFLA

THHNLSLDIFSSRLYNIRDPENQQNLCRLVQEGAQVAAMDLYEFKKCWKKFVDNGG

RRFRPWKKLLTNFRYQDSKLQEILRPCYIPVPSSSSSTLSNICLTKGLPETRFCVERRR

VHLLSEEEFYSQFYNQRVKHLCYYHGVKPYLCYQLEQFNGQAPLKGCLLSEKGKQ*H*

*AEILFLDKIRSMELSQVIITCYLTWSPCPNC*AWQLAAFKRDRPDLILHIYTSRLYFHWKR

PFQKGLCSLWQSGILVDVMDLPQFTDCWTNFVNPKRPFWPWKGLEIISRRTQRRLHR

IKESWGLQDLVNDFGNLQLGPPMS (italic: nucleic acid editing domain)

Rhesus macaque APOBEC-3G:

(SEQ ID NO: 74)

MVEPMDPRTFVSNFNNRPILSGLNTVWLCCEVKTKDPSGPPLDAKIFQGKVYSKAKY

*HPEMRFLRWFHKWRQLHHDQEYKVTWYVSWSPCTRC*ANSVATFLAKDPKVTLTIFVA

RLYYFWKPDYQQALRILCQKRGGPHATMKIMNYNEFQDCWNKFVDGRGKPFKPRN

NLPKHYTLLQATLGELLRHLMDPGTFTSNFNNKPWVSGQHETYLCYKVERLHNDT

WVPLNQHRGFLRNQAPNIHGFPKGR*HAELCFLDLIPFWKLDGQQYRVTCFTSWSPCFS*

*C*AQEMAKFISNNEHVSLCIFAARIYDDQGRYQEGLRALHRDGAKIAMMNYSEFEYC

WDTFVDRQGRPFQPWDGLDEHSQALSGRLRAI (italic: nucleic acid editing domain; underline: cytoplasmic localization signal)

Chimpanzee APOBEC-3 G:

(SEQ ID NO: 75)

MKPHFRNPVERMYQDTFSDNFYNRPILSHRNTVWLCYEVKTKGPSRPPLDAKIFRGQ

VYSKLKY*HPEMRFFHWFSKWRKLHRDQEYEVIWYISWSPCTKC*TRDVATFLAEDPKV

TLTIFVARLYYFWDPDYQEALRSLCQKRDGPRATMKININYDEFQHCWSKFVYSQRE

LFEPWNNLPKYYILLHIEVILGEILRHSMDPPTFTSNFNNELWVRGRHETYLCYEVERL

HNDTWVLLNQRRGFLCNQAPHKHGFLEGR*HAELCFLDVIPFWKLDLHQDYRVTCFTS*

-continued

*WSPCFSC*AQEMAKFISNNKHVSLCIFAARIYDDQGRCQEGLRTLAKAGAKISIMTYSE

FKHCWDTFVDHQGCPFQPWDGLEEHSQALSGRLRAILQNQGN (italic: nucleic acid editing domain; underline: cytoplasmic localization signal)

Green monkey APOBEC-3G:

(SEQ ID NO: 76)

MNPQIRNMVEQMEPDIFVYYFNNRPILSGRNTVWLCYEVKTKDPSGPPLDANIFQGK

LYPEAKD*HPEMKFLHWFRKWRQLHRDQEYEVTWYVSWSPCTRC*ANSVATFLAEDPKV

TLTIFVARLYYFWKPDYQQALRILCQERGGPHATMKIMNYNEFQHCWNEFVDGQG

KPFKPRKNLPKHYTLLHATLGELLRHVMDPGTFTSNFNNKPWVSGQRETYLCYKVE

RSHNDTWVLLNQHRGFLRNQAPDRHGFPKGR*HAELCFLDLIPFWKLDDQQYRVTCFT*

*SWSPCFSC*AQKMAKFISNNKHVSLCIFAARIYDDQGRCQEGLRTLHRDGAKIAVMNY

SEFEYCWDTFVDRQGRPFQPWDGLDEHSQALSGRLRAI (italic: nucleic acid editing domain; underline: cytoplasmic localization signal)

Human APOBEC-3G:

(SEQ ID NO: 77)

MKPHFRNTVERMYRDTFSYNFYNRPILSRRNTVWLCYEVKTKGPSRPPLDAKIFRGQ

VYSELKY*HPEMRFFHWFSKWRKLHRDQEYEVTWYISWSPCTKC*TRDMATFLAEDPKV

TLTIFVARLYYFWDPDYQEALRSLCQKRDGPRATMKEVINYDEFQHCWSKFVYSQRE

LFEPWNNLPKYYILLHIIVILGEILRHSMDPPTFTFNFNNEPWVRGRHETYLCYEVERM

HNDTWVLLNQRRGFLCNQAPHKHGFLEGR*HAELCFLDVIPFWKLDLDQDYRVTCFTS*

*WSPCFSC*AQEMAKFISKNKHVSLCIFTARIYDDQGRCQEGLRTLAEAGAKISIMTYSE

FKHCWDTFVDHQGCPFQPWDGLDEHSQDLSGRLRAILQNQEN (italic: nucleic acid editing domain; underline: cytoplasmic localization signal)

Human APOBEC-3F:

(SEQ ID NO: 78)

MKPHFRNTVERMYRDTFSYNFYNRPILSRRNTVWLCYEVKTKGPSRPRLDAKIFRGQ

VYSQPEH*HAEMCFLSWFCGNQLPAYKCFQIIWFVSWTPCPDC*VAKLAEFLAEHPNVTL

TISAARLYYYWERDYRRALCRLSQAGARVKIMDDEEFAYCWENFVYSEGQPFMPW

YKFDDNYAFLHRTLKEILRNPMEAMYPHIFYFHFKNLRKAYGRNESWLCFTMEVVK

HHSPVSWKRGVFRNQVDPETHC*HAERCFLSWFCDDILSPNTNYEVTWYTSWSPCPEC*A

GEVAEFLARHSNVNLTIFTARLYYFWDTDYQEGLRSLSQEGASVEIMGYKDFKYCW

ENFVYNDDEPFKPWKGLKYNFLFLDSKLQEILE (italic: nucleic acid editing domain)

Human APOBEC-3B:

(SEQ ID NO: 79)

MNPQIRNPMERMYRDTFYDNFENEPILYGRSYTWLCYEVKIKRGRSNLLWDTGVFR

GQVYFKPQY*HAEMCFLSWFCGNQLPAYKCFQITWFVSWIPCPDC*VAKLAEFLSEHPN

VTLTISAARLYYYWERDYRRALCRLSQAGARVTIMDYEEFAYCWENFVYNEGQQF

-continued

MPWYKFDENYAFLHRTLKEILRYLMDPDTFTFNFNNDPLVLRRRQTYLCYEVERLD

NGTWVLMDQHMGFLCNEAKNLLCGFY*GRHAELRFLDLVPSLQLDPAQIYRVIWFISWS*

*PCFSWGC*AGEVRAFLQENTHVRLRIFAARIYDYDPLYKEALQMLRDAGAQVSIMTY

DEFEYCWDTFVYRQGCPFQPWDGLEEHSQALSGRLRAILQNQGN (italic: nucleic acid editing domain)

Rat APOBEC3:

(SEQ ID NO: 80)

MQPQGLGPNAGMGPVCLGCSHRRPYSPIRNPLKKLYQQTFYFHFKNVRYAWGRKN

NFLCYEVNGMDCALPVPLRQGVFRKQGHIHAELCFIYWFHDKVLRVLSPMEEFKVT

WYMSWSPCSKCAEQVARFLAAHRNLSLAIFSSRLYYYLRNPNYQQKLCRLIQEGVH

VAAMDLPEFKKCWNKFVDNDGQPFRPWMRLRINFSFYDCKLQEIFSRMNLLREDVF

YLQFNNSHRVKPVQNRYYRRKSYLCYQLERANGQEPLKGYLLYKKGEQHVEILFLE

KMRSMELSQVRITCYLTWSPCPNCARQLAAFKKDHPDLILRIYTSRLYFYWRKKFQK

GLCTLWRSGIHVDVMDLPQFADCWTNFVNPQRPFRPWNELEKNSWRIQRRLRRIKE

SWGL

Bovine APOBEC-3B:

(SEQ ID NO: 81)

DGWEVAFRSGTVLKAGVLGVSMTEGWAGSGHPGQGACVWTPGTRNTMNLLREVL

FKQQFGNQPRVPAPYYRRKTYLCYQLKQRNDLTLDRGCFRNKKQRHAEIRFIDKINS

LDLNPSQSYKIICYITWSPCPNCANELVNFITRNNHLKLEIFASRLYFHWIKSFKMGLQ

DLQNAGISVAVMTHTEFEDCWEQFVDNQSRPFQPWDKLEQYSASIRRRLQRILTAPI

Chimpanzee APOB EC-3B:

(SEQ ID NO: 82)

MNPQIRNPMEWMYQRTFYYNFENEPILYGRSYTWLCYEVKIRRGHSNLLWDTGVFR

GQMYSQPEHHAEMCFLSWFCGNQLSAYKCFQITWFVSWTPCPDCVAKLAKFLAEH

PNVTLTISAARLYYYWERDYRRALCRLSQAGARVKIMDDEEFAYCWENFVYNEGQP

FMPWYKFDDNYAFLHRTLKEIIRHLMDPDTFTFNFNNDPLVLRRHQTYLCYEVERLD

NGTWVLMDQHMGFLCNEAKNLLCGFYGRHAELRFLDLVPSLQLDPAQIYRVTWFIS

WSPCFSWGCAGQVRAFLQENTHVRLRIFAARIYDYDPLYKEALQMLRDAGAQVSIM

TYDEFEYCWDTFVYRQGCPFQPWDGLEEHSQALSGRLRAILQVRASSLCMVPHRPPP

PPQSPGPCLPLCSEPPLGSLLPTGRPAPSLPFLLTASFSFPPPASLPPLPSLSLSPGHLPVP

SFHSLTSCSIQPPCSSRIRETEGWASVSKEGRDLG

Human APOBEC-3C:

(SEQ ID NO: 83)

MNPQIRNPMKAMYPGTFYFQFKNLWEANDRNETWLCFTVEGIKRRSVVSWKTGVF

RNQVDSETH*CHAERCFLSWFCDDILSPNTKYQVIWYTSWSPCPDC*AGEVAEFLARHSN

VNLTIFTARLYYFQYPCYQEGLRSLSQEGVAVEIMDYEDFKYCWENFVYNDNEPFKP

WKGLKTNFRLLKRRLRESLQ (italic: nucleic acid editing domain)

Gorilla APOBEC3C (SEQ ID NO: 84)

MNPQIRNPMKAMYPGTFYFQFKNLWEANDRNETWLCFTVEGIKRRSVVSWKTGVF

RNQVDSETH*CHAERCFLSWFCDDILSPNTNYQVIWYTSWSPCPEC*AGEVAEFLARHSN

-continued

VNLTIFTARLYYFQDTDYQEGLRSLSQEGVAVKIMDYKDFKYCWENFVYNDDEPFK

PWKGLKYNFRFLKRRLQEILE (italic: nucleic acid editing domain)

Human APOB EC-3A:

(SEQ ID NO: 85)

MEASPASGPRHLMDPHIFTSNFNNGIGRHKTYLCYEVERLDNGTSVKMDQHRGFLH

NQAKNLLCGFYGR*HAELRFLDLVPSLQLDPAQIYRVTWFISWSPCFSWGC*AGEVRAFLQ

ENTHVRLRIFAARIYDYDPLYKEALQMLRDAGAQVSIMTYDEFKHCWDTFVDHQGC

PFQPWDGLDEHSQALSGRLRAILQNQGN (italic: nucleic acid editing domain)

Rhesus macaque APOBEC-3A:

(SEQ ID NO: 86)

MDGSPASRPRHLMDPNTFTFNFNNDLSVRGRHQTYLCYEVERLDNGTWVPMDERR

GFLCNKAKNVPCGDYGC*HVELRFLCEVPSWQLDPAQTYRVIWFISWSPC*FRRGCAGQ

VRVFLQENKHVRLRIFAARIYDYDPLYQEALRTLRDAGAQVSIMTYEEFKHCWDTF

VDRQGRPFQPWDGLDEHSQALSGRLRAILQNQGN (italic: nucleic acid editing domain)

Bovine APOBEC-3A:

(SEQ ID NO: 87)

MDEYTFTENFNNQGWPSKTYLCYEMERLDGDATIPLDEYKGFVRNKGLDQPEKPC*H*

*AELYFLGKIHSWNLDRNQHYRLTCFISWSPC*YDCAQKLTTFLKENHHISLHILASRIYTH

NRFGCHQSGLCELQAAGARITIMTFEDFKHCWETFVDHKGKPFQPWEGLNVKSQAL

CTELQAILKTQQN (italic: nucleic acid editing domain)

Human APOBEC-3H:

(SEQ ID NO: 88)

MALLTAETFRLQFNNKRRLRRPYYPRKALLCYQLTPQNGSTPTRGYFENKKKC*HAEI*

*CFINEIKSMGLDETQCYQVTCYLTWSPCSSC*AWELVDFIKAHDHLNLGIFASRLYYHWC

KPQQKGLRLLCGSQVPVEVMGFPKFADCWENFVDHEKPLSFNPYKMLEELDKNSRA

IKRRLERIKIPGVRAQGRYMDILCDAEV (italic: nucleic acid editing domain)

Rhesus macaque APOBEC-3H:

(SEQ ID NO: 89)

MALLTAKTFSLQFNNKRRVNKPYYPRKALLCYQLTPQNGSTPTRGHLKNKKKDHAE

IRFINKIKSMGLDETQCYQVTCYLTWSPCPSCAGELVDFIKAHRHLNLRIFASRLYYH

WRPNYQEGLLLLCGSQVPVEVMGLPEFTDCWENFVDHKEPPSFNPSEKLEELDKNS

QAIKRRLERIKSRSVDVLENGLRSLQLGPVTPSSSIRNSR

Human APOBEC-3D:

(SEQ ID NO: 90)

MNPQRNPMERMYRDTFYDNFENEPILYGRSYTWLCYEVKIKRGRSNLLWDTGVFR

GPVLPKRQSNHRQEVYFRFEN*HAEMCFLSWFCGNRLPANRRFQITWFVSWNPCLPC*VV

KVTKFLAEHPNVTLTISAARLYYYRDRDWRWVLLRLHKAGARVKIMDYEDFAYCW

ENFVCNEGQPFMPWYKFDDNYASLHRTLKEILRNPMEAMYPHIFYFHFKNLLKACG

RNESWLCFTMEVTKHHSAVFRKRGVFRNQVDPETHC*HAERCFLSWFCDDILSPNTNY*

-continued

*EVTWYTSWSPCPEC*AGEVAEFLARHSNVNLTIFTARLCYFWDTDYQEGLCSLSQEGAS

VKIMGYKDFVSCWKNFVYSDDEPFKPWKGLQTNFRLLKRRLREILQ (italic: nucleic acid editing domain)

Human APOBEC-1:

(SEQ ID NO: 91)

MTSEKGPSTGDPTLRRRIEPWEFDVFYDPRELRKEACLLYEIKWGMSRKIWRSSGKN

TTNHVEVNFIKKFTSERDFHPSMSCSITWFLSWSPCWECSQAIREFLSRHPGVTLVIYV

ARLFWHMDQQNRQGLRDLVNSGVTIQIIVIRASEYYHCWRNFVNYPPGDEAHWPQY

PPLWMMLYALELHCIILSLPPCLKISRRWQNHLTFFRLHLQNCHYQTIPPHILLATGLI

HPSVAWR

Mouse APOBEC-1:

(SEQ ID NO: 92)

MSSETGPVAVDPTLRRRIEPHEFEVFFDPRELRKETCLLYEINWGGRHSVWRHTSQN

TSNHVEVNFLEKFTTERYFRPNTRCSITWFLSWSPCGECSRAITEFLSRHPYVTLFIYIA

RLYHHTDQRNRQGLRDLISSGVTIQIMTEQEYCYCWRNFVNYPPSNEAYWPRYPHL

WVKLYVLELYCIILGLPPCLKILRRKQPQLTFFTITLQTCHYQRIPPHLLWATGLK

Rat APOBEC-1:

(SEQ ID NO: 93)

MSSETGPVAVDPTLRRRIEPHEFEVFFDPRELRKETCLLYEINWGGRHSIWRHTSQNT

NKHVEVNFIEKFTTERYFCPNTRCSITWFLSWSPCGECSRAITEFLSRYPHVTLFIYIAR

LYHHADPRNRQGLRDLISSGVTIQIMTEQESGYCWRNFVNYSPSNEAHWPRYPHLW

VRLYVLELYCIILGLPPCLNILRRKQPQLTFFTIALQSCHYQRLPPHILWATGLK

Human APOBEC-2:

(SEQ ID NO: 94)

MAQKEEAAVATEAASQNGEDLENLDDPEKLKELIELPPFEIVTGERLPANFFKFQFRN

VEYSSGRNKTFLCYVVEAQGKGGQVQASRGYLEDEHAAAHAEEAFFNTILPAFDPA

LRYNVTWYVSSSPCAACADRIIKTLSKTKNLRLLILVGRLFMWEEPEIQAALKKLKE

AGCKLRIMKPQDFEYVWQNFVEQEEGESKAFQPWEDIQENFLYYEEKLADILK

Mouse APOBEC-2:

(SEQ ID NO: 95)

MAQKEEAAEAAAPASQNGDDLENLEDPEKLKELIDLPPFEIVTGVRLPVNFFKFQFR

NVEYSSGRNKTFLCYVVEVQSKGGQAQATQGYLEDEHAGAHAEEAFFNTILPAFDP

ALKYNVTWYVSSSPCAACADRILKTLSKTKNLRLLILVSRLFMWEEPEVQAALKKLK

EAGCKLRIMKPQDFEYIWQNFVEQEEGESKAFEPWEDIQENFLYYEEKLADILK

Rat APOBEC-2:

(SEQ ID NO: 96)

MAQKEEAAEAAAPASQNGDDLENLEDPEKLKELIDLPPFEIVTGVRLPVNFFKFQFR

NVEYSSGRNKTFLCYVVEAQSKGGQVQATQGYLEDEHAGAHAEEAFFNTILPAFDP

ALKYNVTWYVSSSPCAACADRILKTLSKTKNLRLLILVSRLFMWEEPEVQAALKKLK

EAGCKLRIMKPQDFEYLWQNFVEQEEGESKAFEPWEDIQENFLYYEEKLADILK

Bovine APOBEC-2:

(SEQ ID NO: 97)

MAQKEEAAAAAEPASQNGEEVENLEDPEKLKELIELPPFEIVTGERLPAHYFKFQFRN

VEYSSGRNKTFLCYVVEAQSKGGQVQASRGYLEDEHATNHAEEAFFNSIMPTFDPA

LRYMVTWYVSSSPCAACADRIVKTLNKTKNLRLLILVGRLFMWEEPEIQAALRKLKE

AGCRLRIMKPQDFEYIWQNFVEQEEGESKAFEPWEDIQENFLYYEEKLADILK

-continued

*Petromyzon marinus* CDA1 (pmCDA1)

(SEQ ID NO: 98)

MTDAEYVRIHEKLDIYTFKKQFFNNKKSVSHRCYVLFELKRRGERRACFWGYAVNK

PQSGTERGIHAEIFSIRKVEEYLRDNPGQFTINWYSSWSPCADCAEKILEWYNQELRG

NGHTLKIWACKLYYEKNARNQIGLWNLRDNGVGLNVMVSEHYQCCRKIFIQSSHNQ

LNENRWLEKTLKRAEKRRSELSIMIQVKILHTTKSPAV

Human APOBEC3G D316R D317R (SEQ ID NO: 99)

MKPHFRNTVERMYRDTFSYNFYNRPILSRRNTVWLCYEVKTKGPSRPPLDAKIFRGQ

VYSELKYHPEMRFFHWFSKWRKLHRDQEYEVTWYISWSPCTKCTRDMATFLAEDP

KVTLTIFVARLYYFWDPDYQEALRSLCQKRDGPRATMKIMNYDEFQHCWSKFVYS

QRELFEPWNNLPKYYILLHIMLGEILRHSMDPPTFTFNFNNEPWVRGRHETYLCYEV

ERMHNDTWVLLNQRRGFLCNQAPHKHGFLEGRHAELCFLDVIPFWKLDLDQDYRV

TCFTSWSPCFSCAQEMAKFISKNKHVSLCIFTARIYRRQGRCQEGLRTLAEAGAKISI

MTYSEFKHCWDTFVDHQGCPFQPWDGLDEHSQDLSGRLRAILQNQEN

Human APOBEC3G chain A (SEQ ID NO: 100)

MDPPTFTFNFNNEPWVRGRHETYLCYEVERMHNDTWVLLNQRRGFLCNQAPHKHG

FLEGRHAELCFLDVIPFWKLDLDQDYRVTCFTSWSPCFSCAQEMAKFISKNKHVSLCI

FTARIYDDQGRCQEGLRTLAEAGAKISIMTYSEFKHCWDTFVDHQGCPFQPWDGLD

EHSQDLSGRLRAILQ

Human APOBEC3G chain A D120R D121R (SEQ ID NO: 101)

MDPPTFTFNFNNEPWVRGRHETYLCYEVERMHNDTWVLLNQRRGFLCNQAPHKHG

FLEGRHAELCFLDVIPFWKLDLDQDYRVTCFTSWSPCFSCAQEMAKFISKNKHVSLCI

FTARIYRRQGRCQEGLRTLAEAGAKISIMTYSEFKHCWDTFVDHQGCPFQPWDGLDE

HSQDLSGRLRAILQ

Deaminase Domains that Modulate the Editing Window of Base Editors

Some aspects of the disclosure are based on the recognition that modulating the deaminase domain catalytic activity of any of the fusion proteins provided herein, for example by making point mutations in the deaminase domain, affect the processivity of the fusion proteins (e.g., base editors). For example, mutations that reduce, but do not eliminate, the catalytic activity of a deaminase domain within a base editing fusion protein can make it less likely that the deaminase domain will catalyze the deamination of a residue adjacent to a target residue, thereby narrowing the deamination window. The ability to narrow the deaminataion window may prevent unwanted deamination of residues adjacent of specific target residues, which may decrease or prevent off-target effects.

In some embodiments, any of the fusion proteins provided herein comprise a deaminase domain (e.g., a cytidine deaminase domain) that has reduced catalytic deaminase activity. In some embodiments, any of the fusion proteins provided herein comprise a deaminase domain (e.g., a cytidine deaminase domain) that has a reduced catalytic deaminase activity as compared to an appropriate control. For example, the appropriate control may be the deaminase activity of the deaminase prior to introducing one or more mutations into the deaminase. In other embodiments, the appropriate control may be a wild-type deaminase. In some embodiments, the appropriate control is a wild-type apolipoprotein B mRNA-editing complex (APOBEC) family deaminase. In some embodiments, the appropriate control is an APOBEC1 deaminase, an APOBEC2 deaminase, an APOBEC3A deaminase, an APOBEC3B deaminase, an APOBEC3C deaminase, an APOBEC3D deaminase, an APOBEC3F deaminase, an APOBEC3G deaminase, or an APOBEC3H deaminase. In some embodiments, the appropriate control is an activation induced deaminase (AID). In some embodiments, the appropriate control is a cytidine deaminase 1 from *Petromyzon marinus* (pmCDA1). In some embodiments, the deaminase domain may be a deaminase domain that has at least 1%, at least 5%, at least 15%, at least 20%, at least 25%, at least 30%, at least 40%, at least 50%, at least 60%, at least 70%, at least 80%, at least 90%, or at least 95% less catalytic deaminase activity as compared to an appropriate control.

In some embodiments, any of the fusion proteins provided herein comprise an APOBEC deaminase comprising one or more mutations selected from the group consisting of H121X, H122X, R126X, R126X, R118X, W90X, W90X, and R132X of rAPOBEC1 (SEQ ID NO: 93), or one or more corresponding mutations in another APOBEC deaminase, wherein X is any amino acid. In some embodiments, any of the fusion proteins provided herein comprise an APOBEC deaminase comprising one or more mutations selected from the group consisting of H121R, H122R, R126A, R126E, R118A, W90A, W90Y, and R132E of rAPOBEC1 (SEQ ID NO: 93), or one or more corresponding mutations in another APOBEC deaminase.

In some embodiments, any of the fusion proteins provided herein comprise an APOBEC deaminase comprising one or more mutations selected from the group consisting of D316X, D317X, R320X, R320X, R313X, W285X, W285X, R326X of hAPOBEC3G (SEQ ID NO: 77), or one or more corresponding mutations in another APOBEC deaminase, wherein X is any amino acid. In some embodiments, any of the fusion proteins provided herein comprise an APOBEC deaminase comprising one or more mutations selected from the group consisting of D316R, D317R, R320A, R320E, R313A, W285A, W285Y, R326E of hAPOBEC3G (SEQ ID NO: 77), or one or more corresponding mutations in another APOBEC deaminase.

In some embodiments, any of the fusion proteins provided herein comprise an APOBEC deaminase comprising a H121R and a H122 Rmutation of rAPOBEC1 (SEQ ID NO: 93), or one or more corresponding mutations in another APOBEC deaminase. In some embodiments, any of the fusion proteins provided herein comprise an APOBEC deaminase comprising a R126A mutation of rAPOBEC1 (SEQ ID NO: 93), or one or more corresponding mutations in another APOBEC deaminase. In some embodiments, any of the fusion proteins provided herein comprise an APOBEC deaminase comprising a R126E mutation of rAPOBEC1 (SEQ ID NO: 93), or one or more corresponding mutations in another APOBEC deaminase. In some embodiments, any of the fusion proteins provided herein comprise an APOBEC deaminase comprising a R118A mutation of rAPOBEC1 (SEQ ID NO: 93), or one or more corresponding mutations in another APOBEC deaminase. In some embodiments, any of the fusion proteins provided herein comprise an APOBEC deaminase comprising a W90A mutation of rAPOBEC1 (SEQ ID NO: 93), or one or more corresponding mutations in another APOBEC deaminase. In some embodiments, any of the fusion proteins provided herein comprise an APOBEC deaminase comprising a W90Y mutation of rAPOBEC1 (SEQ ID NO: 93), or one or more corresponding mutations in another APOBEC deaminase. In some embodiments, any of the fusion proteins provided herein comprise an APOBEC deaminase comprising a R132E mutation of rAPOBEC1 (SEQ ID NO: 93), or one or more corresponding mutations in another APOBEC deaminase. In some embodiments, any of the fusion proteins provided herein comprise an APOBEC deaminase comprising a W90Y and a R126E mutation of rAPOBEC1 (SEQ ID NO: 93), or one or more corresponding mutations in another APOBEC deaminase. In some embodiments, any of the fusion proteins provided herein comprise an APOBEC deaminase comprising a R126E and a R132E mutation of rAPOBEC1 (SEQ ID NO: 93), or one or more corresponding mutations in another APOBEC deaminase. In some embodiments, any of the fusion proteins provided herein comprise an APOBEC deaminase comprising a W90Y and a R132E mutation of rAPOBEC1 (SEQ ID NO: 93), or one or more corresponding mutations in another APOBEC deaminase. In some embodiments, any of the fusion proteins provided herein comprise an APOBEC deaminase comprising a W90Y, R126E, and R132E mutation of rAPOBEC1 (SEQ ID NO: 93), or one or more corresponding mutations in another APOBEC deaminase.

In some embodiments, any of the fusion proteins provided herein comprise an APOBEC deaminase comprising a D316R and a D317R mutation of hAPOBEC3G (SEQ ID NO: 77), or one or more corresponding mutations in another APOBEC deaminase. In some embodiments, any of the fusion proteins provided herein comprise an APOBEC deaminase comprising a R320A mutation of hAPOBEC3G (SEQ ID NO: 77), or one or more corresponding mutations in another APOBEC deaminase. In some embodiments, any of the fusion proteins provided herein comprise an APOBEC deaminase comprising a R320E mutation of hAPOBEC3G (SEQ ID NO: 77), or one or more corresponding mutations in another APOBEC deaminase. In some embodiments, any of the fusion proteins provided herein comprise an APOBEC deaminase comprising a R313A mutation of hAPOBEC3G (SEQ ID NO: 77), or one or more corresponding mutations in another APOBEC deaminase. In some embodiments, any of the fusion proteins provided herein comprise an APOBEC deaminase comprising a W285A mutation of hAPOBEC3G (SEQ ID NO: 77), or one or more corresponding mutations in another APOBEC deaminase. In some embodiments, any of the fusion proteins provided herein comprise an APOBEC deaminase comprising a W285Y mutation of hAPOBEC3G (SEQ ID NO: 77), or one or more corresponding mutations in another APOBEC deaminase. In some embodiments, any of the fusion proteins provided herein comprise an APOBEC deaminase comprising a R326E mutation of hAPOBEC3G (SEQ ID NO: 77), or one or more corresponding mutations in another APOBEC deaminase. In some embodiments, any of the fusion proteins provided herein comprise an APOBEC deaminase comprising a W285Y and a R320E mutation of hAPOBEC3G (SEQ ID NO: 77), or one or more corresponding mutations in another APOBEC deaminase. In some embodiments, any of the fusion proteins provided herein comprise an APOBEC deaminase comprising a R320E and a R326E mutation of hAPOBEC3G (SEQ ID NO: 77), or one or more corresponding mutations in another APOBEC deaminase. In some embodiments, any of the fusion proteins provided herein comprise an APOBEC deaminase comprising a W285Y and a R326E mutation of hAPOBEC3G (SEQ ID NO: 77), or one or more corresponding mutations in another APOBEC deaminase. In some embodiments, any of the fusion proteins provided herein comprise an APOBEC deaminase comprising a W285Y, R320E, and R326E mutation of hAPOBEC3G (SEQ ID NO: 77), or one or more corresponding mutations in another APOBEC deaminase.

Fusion Proteins Comprising a Nuclease Programmable DNA Binding Protein (napDNAbp), a Cytidine Deaminase, and a Uracil Binding Protein (UBP)

Some aspects of the disclosure provide fusion proteins comprising a nucleic acid programmable DNA binding protein (napDNAbp), a cytidine deaminase, and a uracil binding protein (UBP). In some embodiments, any of the fusion proteins provided herein are base editors. In some embodiments, the UBP is a uracil modifying enzyme. In some embodiments, the UBP is a uracil base excision enzyme. In some embodiments, the UBP is a uracil DNA glycosylase. In some embodiments, the UBP is any of the uracil binding proteins provided herein. For example, the UBP may be a UDG, a UdgX, a UdgX*, a UdgX_On, or a SMUG1. In some embodiments, the UBP comprises an amino acid sequence that is at least 75%, 80%, 85%, 90%, 95%, 96%, 97%, 98%, 99%, or 99.5% identical to a uracil binding protein, a uracil base excision enzyme or a uracil DNA glycosylase (UDG) enzyme. In some embodiments, the UBP comprises an amino acid sequence that is at least 75%, 80%, 85%, 90%, 95%, 96%, 97%, 98%, 99%, or 99.5% identical to any of the uracil binding proteins provided herein. For example, the UBP may comprise an amino acid sequence that is at least 75%, 80%, 85%, 90%, 95%, 96%, 97%, 98%, 99%, or 99.5% identical to any one of SEQ ID NOs: 48-53. In some embodiments, the UBP comprises the amino acid sequence of any one of SEQ ID NOs: 48-53.

In some embodiments, the napDNAbp is a Cas9 domain, a Cpf1 domain, a CasX domain, a CasY domain, a C2c1 domain, a C2c2 domain, aC2c3 domain, or an Argonaute domain. In some embodiments, the napDNAbp is any napDNAbp provided herein. In some embodiments, the napDNAbp of any of the fusion proteins provided herein is a Cas9 domain. The Cas9 domain may be any of the Cas9 domains or Cas9 proteins (e.g., dCas9 or nCas9) provided herein. In some embodiments, any of the Cas9 domains or Cas9 proteins (e.g., dCas9 or nCas9) provided herein may be fused with any of the cytidine deaminases provided herein. In some embodiments, the fusion protein comprises the structure:

$NH_2$-[cytidine deaminase]-[napDNAbp]-[UBP]-COOH;
$NH_2$-[cytidine deaminase]-[UBP]-[napDNAbp]-COOH;
$NH_2$-[UBP]-[cytidine deaminase]-[napDNAbp]-COOH;
$NH_2$-[UBP]-[napDNAbp]-[cytidine deaminase]-COOH;
$NH_2$-[napDNAbp]-[UBP]-[cytidine deaminase]-COOH; or
$NH_2$-[napDNAbp]-[cytidine deaminase]-[UBP]-COOH In some embodiments, the fusion proteins comprising a cytidine deaminase, a napDNAbp (e.g., Cas9 domain), and UBP do not include a linker sequence. In some embodiments, a linker is present between the cytidine deaminase domain and the napDNAbp. In some embodiments, a linker is present between the cytidine deaminase domain and the UBP. In some embodiments, a linker is present between the napDNAbp and the UBP. In some embodiments, the "-" used in the general architecture above indicates the presence of an optional linker. In some embodiments, the cytidine deaminase and the napDNAbp, the cytidine deaminase and the UBP, and/or the napDNAbp and the UBP are fused via any of the linkers provided herein. For example, in some embodiments the cytidine deaminase and the napDNAbp, the cytidine deaminase and the UBP, and/or the napDNAbp and the UBP are fused via any of the linkers provided below in the section entitled "Linkers". In some embodiments, the cytidine deaminase and the napDNAbp, the cytidine deaminase and the UBP, and/or the napDNAbp and the UBP are fused via a linker that comprises between 1 and 200 amino acids. In some embodiments, the cytidine deaminase and the napDNAbp, the cytidine deaminase and the UBP, and/or the napDNAbp and the UBP are fused via a linker that comprises from 1 to 5, 1 to 10, 1 to 20, 1 to 30, 1 to 40, 1 to 50, 1 to 60, 1 to 80, 1 to 100, 1 to 150, 1 to 200, 5 to 10, 5 to 20, 5 to 30, 5 to 40, 5 to 60, 5 to 80, 5 to 100, 5 to 150, 5 to 200, 10 to 20, 10 to 30, 10 to 40, 10 to 50, 10 to 60, 10 to 80, 10 to 100, 10 to 150, 10 to 200, 20 to 30, 20 to 40, 20 to 50, 20 to 60, 20 to 80, 20 to 100, 20 to 150, 20 to 200, 30 to 40, 30 to 50, 30 to 60, 30 to 80, 30 to 100, 30 to 150, 30 to 200, 40 to 50, 40 to 60, 40 to 80, 40 to 100, 40 to 150, 40 to 200, 50 to 60 50 to 80, 50 to 100, 50 to 150, 50 to 200, 60 to 80, 60 to 100, 60 to 150, 60 to 200, 80 to 100, 80 to 150, 80 to 200, 100 to 150, 100 to 200, or 150 to 200 amino acids in length. In some embodiments, the cytidine deaminase and the napDNAbp, the cytidine deaminase and the UBP, and/or the napDNAbp and the UBP are fused via a linker that comprises 4, 16, 24, 32, 91 or 104 amino acids in length. In some embodiments, the cytidine deaminase and the napDNAbp, the cytidine deaminase and the UBP, and/or the napDNAbp and the UBP are fused via a linker that comprises the amino acid sequence of SGSETPGTSESATPES (SEQ ID NO: 102), SGGS (SEQ ID NO: 103), SGGSSGSETPGTSESATPESSGGS (SEQ ID NO: 107), SGGSSGGSSGSETPGTSESATPESSGGSSGGS (SEQ ID NO: 108), GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS (SEQ ID NO: 109), or SGGSGGSGGS (SEQ ID NO: 120). In some embodiments, the cytidine deaminase and the napDNAbp, the cytidine deaminase and the UBP, and/or the napDNAbp and the UBP are fused via a linker comprising the amino acid sequence SGSETPGTSESATPES (SEQ ID NO: 102), which may also be referred to as the XTEN linker.

Fusion Proteins Comprising a Nuclease Programmable DNA Binding Protein (napDNAbp), a Cytidine Deaminase, and a Nucleic Acid Polymerase (NAP) Domain Some aspects of the disclosure provide fusion proteins comprising a nucleic acid programmable DNA binding protein (napDNAbp), a cytidine deaminase, and a nucleic acid polymerase (NAP) domain. In some embodiments, any of the fusion proteins provided herein are base editors. In some embodiments, the NAP is a eukaryotic nucleic acid polymerase. In some embodiments, the NAP is a DNA polymerase. In some embodiments, the NAP has translesion polymerase activity. In some embodiments, the NAP is a translesion DNA polymerase. In some embodiments, the NAP is a Rev7, Rev1 complex, polymerase iota, polymerase kappa, or polymerase eta. In some embodiments, the NAP is a eukaryotic polymerase alpha, beta, gamma, delta, epsilon, gamma, eta, iota, kappa, lambda, mu, or nu. In some embodiments, the NAP comprises an amino acid sequence that is at least 75%, 80%, 85%, 90%, 95%, 96%, 97%, 98%, 99%, or 99.5% identical to a nucleic acid polymerase (e.g., a translesion DNA polymerase). In some embodiments, the NAP comprises an amino acid sequence that is at least 75%, 80%, 85%, 90%, 95%, 96%, 97%, 98%, 99%, or 99.5% identical to any of the nucleic acid polymerases provided herein. For example, the NAP may comprise an amino acid sequence that is at least 75%, 80%, 85%, 90%, 95%, 96%, 97%, 98%, 99%, or 99.5% identical to any one of SEQ ID NOs: 54-64. In some embodiments, the NAP comprises the amino acid sequence of any one of SEQ ID NOs: 54-64.

In some embodiments, the napDNAbp is a Cas9 domain, a Cpf1 domain, a CasX domain, a CasY domain, a C2c1 domain, a C2c2 domain, aC2c3 domain, or an Argonaute domain. In some embodiments, the napDNAbp is any napDNAbp provided herein. In some embodiments, the napDNAbp of any of the fusion proteins provided herein is a Cas9 domain. The Cas9 domain may be any of the Cas9 domains or Cas9 proteins (e.g., dCas9 or nCas9) provided herein. In some embodiments, any of the Cas9 domains or Cas9 proteins (e.g., dCas9 or nCas9) provided herein may be fused with any of the cytidine deaminases provided herein. In some embodiments, the fusion protein comprises the structure:

$NH_2$-[cytidine deaminase]-[napDNAbp]-[NAP]-COOH;
$NH_2$-[cytidine deaminase]-[NAP]-[napDNAbp]-COOH;
$NH_2$-[NAP]-[cytidine deaminase]-[napDNAbp]-COOH;
$NH_2$-[NAP]-[napDNAbp]-[cytidine deaminase]-COOH;
$NH_2$-[napDNAbp]-[NAP]-[cytidine deaminase]-COOH; or
$NH_2$-[napDNAbp]-[cytidine deaminase]-[NAP]-COOH In some embodiments, the fusion proteins comprising a cytidine deaminase, a napDNAbp (e.g., Cas9 domain), and NAP do not include a linker sequence. In some embodiments, a linker is present between the cytidine deaminase domain and the napDNAbp. In some embodiments, a linker is present between the cytidine deaminase domain and the NAP. In some embodiments, a linker is present between the napDNAbp and the NAP. In some embodiments, the "-"

used in the general architecture above indicates the presence of an optional linker. In some embodiments, the cytidine deaminase and the napDNAbp, the cytidine deaminase and the NAP, and/or the napDNAbp and the NAP are fused via any of the linkers provided herein. For example, in some embodiments the cytidine deaminase and the napDNAbp, the cytidine deaminase and the NAP, and/or the napDNAbp and the NAP are fused via any of the linkers provided below in the section entitled "Linkers". In some embodiments, the cytidine deaminase and the napDNAbp, the cytidine deaminase and the NAP, and/or the napDNAbp and the NAP are fused via a linker that comprises between 1 and 200 amino acids. In some embodiments, the cytidine deaminase and the napDNAbp, the cytidine deaminase and the NAP, and/or the napDNAbp and the NAP are fused via a linker that comprises from 1 to 5, 1 to 10, 1 to 20, 1 to 30, 1 to 40, 1 to 50, 1 to 60, 1 to 80, 1 to 100, 1 to 150, 1 to 200, 5 to 10, 5 to 20, 5 to 30, 5 to 40, 5 to 60, 5 to 80, 5 to 100, 5 to 150, 5 to 200, 10 to 20, 10 to 30, 10 to 40, 10 to 50, 10 to 60, 10 to 80, 10 to 100, 10 to 150, 10 to 200, 20 to 30, 20 to 40, 20 to 50, 20 to 60, 20 to 80, 20 to 100, 20 to 150, 20 to 200, 30 to 40, 30 to 50, 30 to 60, 30 to 80, 30 to 100, 30 to 150, 30 to 200, 40 to 50, 40 to 60, 40 to 80, 40 to 100, 40 to 150, 40 to 200, 50 to 60 50 to 80, 50 to 100, 50 to 150, 50 to 200, 60 to 80, 60 to 100, 60 to 150, 60 to 200, 80 to 100, 80 to 150, 80 to 200, 100 to 150, 100 to 200, or 150 to 200 amino acids in length. In some embodiments, the cytidine deaminase and the napDNAbp, the cytidine deaminase and the NAP, and/or the napDNAbp and the NAP are fused via a linker that comprises 4, 16, 32, or 104 amino acids in length. In some embodiments, the cytidine deaminase and the napDNAbp, the cytidine deaminase and the NAP, and/or the napDNAbp and the NAP are fused via a linker that comprises the amino acid sequence of SGSETPGTSESATPES (SEQ ID NO: 102), SGGS (SEQ ID NO: 103), SGGSSGSETPGTSESATPESSGGS (SEQ ID NO: 107), SGGSSGGSSGSETPGTSESATPESSGGSSGGS (SEQ ID NO: 108), GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS (SEQ ID NO: 109), or SGGSGGSGGS (SEQ ID NO: 120). In some embodiments, the cytidine deaminase and the napDNAbp, the cytidine deaminase and the NAP, and/or the napDNAbp and the NAP are fused via a linker comprising the amino acid sequence SGSETPGTSESATPES (SEQ ID NO: 102), which may also be referred to as the XTEN linker.

Fusion Proteins Comprising a Nuclease Programmable DNA Binding Protein (napDNAbp), a Cytidine Deaminase, a Uracil Binding Protein (UBP), and a Nucleic Acid Polymerase (NAP) Domain Some aspects of the disclosure provide fusion proteins comprising a nucleic acid programmable DNA binding protein (napDNAbp), a cytidine deaminase, a uracil binding protein (UBP), and a nucleic acid polymerase (NAP) domain. In some embodiments, any of the fusion proteins provided herein are base editors. In some embodiments, the NAP is a eukaryotic nucleic acid polymerase. In some embodiments, the NAP is a DNA polymerase. In some embodiments, the NAP has translesion polymerase activity. In some embodiments, the NAP is a translesion DNA polymerase. In some embodiments, the NAP is a Rev7, Rev1 complex, polymerase iota, polymerase kappa, or polymerase eta. In some embodiments, the NAP is a eukaryotic polymerase alpha, beta, gamma, delta, epsilon, gamma, eta, iota, kappa, lambda, mu, or nu. In some embodiments, the NAP comprises an amino acid sequence that is at least 75%, 80%, 85%, 90%, 95%, 96%, 97%, 98%, 99%, or 99.5% identical to a nucleic acid polymerase (e.g., a translesion DNA polymerase). In some embodiments, the NAP comprises an amino acid sequence that is at least 75%, 80%, 85%, 90%, 95%, 96%, 97%, 98%, 99%, or 99.5% identical to any of the nucleic acid polymerases provided herein. For example, the NAP may comprise an amino acid sequence that is at least 75%, 80%, 85%, 90%, 95%, 96%, 97%, 98%, 99%, or 99.5% identical to any one of SEQ ID NOs: 54-64. In some embodiments, the NAP comprises the amino acid sequence of any one of SEQ ID NOs: 54-64.

In some embodiments, the UBP is a uracil modifying enzyme. In some embodiments, the UBP is a uracil base excision enzyme. In some embodiments, the UBP is a uracil DNA glycosylase. In some embodiments, the UBP is any of the uracil binding proteins provided herein. For example, the UBP may be a UDG, a UdgX, a UdgX*, a UdgX_On, or a SMUG1. In some embodiments, the UBP comprises an amino acid sequence that is at least 75%, 80%, 85%, 90%, 95%, 96%, 97%, 98%, 99%, or 99.5% identical to a uracil binding protein, a uracil base excision enzyme or a uracil DNA glycosylase (UDG) enzyme. In some embodiments, the UBP comprises an amino acid sequence that is at least 75%, 80%, 85%, 90%, 95%, 96%, 97%, 98%, 99%, or 99.5% identical to any of the uracil binding proteins provided herein. For example, the UBP may comprise an amino acid sequence that is at least 75%, 80%, 85%, 90%, 95%, 96%, 97%, 98%, 99%, or 99.5% identical to any one of SEQ ID NOs: 48-53. In some embodiments, the UBP comprises the amino acid sequence of any one of SEQ ID NOs: 48-53.

In some embodiments, the napDNAbp is a Cas9 domain, a Cpf1 domain, a CasX domain, a CasY domain, a C2c1 domain, a C2c2 domain, aC2c3 domain, or an Argonaute domain. In some embodiments, the napDNAbp is any napDNAbp provided herein. In some embodiments, the napDNAbp of any of the fusion proteins provided herein is a Cas9 domain. The Cas9 domain may be any of the Cas9 domains or Cas9 proteins (e.g., dCas9 or nCas9) provided herein. In some embodiments, any of the Cas9 domains or Cas9 proteins (e.g., dCas9 or nCas9) provided herein may be fused with any of the cytidine deaminases provided herein. In some embodiments, the fusion protein comprises the structure:

$NH_2$-[NAP]-[cytidine deaminase]-[napDNAbp]-[UBP]-COOH;

$NH_2$-[cytidine deaminase]-[NAP]-[napDNAbp]-[UBP]-COOH;

$NH_2$-[cytidine deaminase]-[napDNAbp]-[NAP]-[UBP]-COOH;

$NH_2$-[cytidine deaminase]-[napDNAbp]-[UBP]-[NAP]-COOH;

$NH_2$-[NAP]-[cytidine deaminase]-[UBP]-[napDNAbp]-COOH;

$NH_2$-[cytidine deaminase]-[NAP]-[UBP]-[napDNAbp]-COOH;

$NH_2$-[cytidine deaminase]-[UBP]-[NAP]-[napDNAbp]-COOH;

$NH_2$-[cytidine deaminase]-[UBP]-[napDNAbp]-[NAP]-COOH;

$NH_2$-[NAP]-[UBP]-[cytidine deaminase]-[napDNAbp]-COOH;

$NH_2$-[UBP]-[NAP]-[cytidine deaminase]-[napDNAbp]-COOH;

$NH_2$-[UBP]-[cytidine deaminase]-[NAP]-[napDNAbp]-COOH;

$NH_2$-[UBP]-[cytidine deaminase]-[napDNAbp]-[NAP]-COOH;

$NH_2$-[NAP]-[UBP]-[napDNAbp]-[cytidine deaminase]-COOH;
$NH_2$-[UBP]-[NAP]-[napDNAbp]-[cytidine deaminase]-COOH;
$NH_2$-[UBP]-[napDNAbp]-[NAP]-[cytidine deaminase]-COOH;
$NH_2$-[UBP]-[napDNAbp]-[cytidine deaminase]-[NAP]-COOH;
$NH_2$-[NAP]-[napDNAbp]-[UBP]-[cytidine deaminase]-COOH;
$NH_2$-[napDNAbp]-[NAP]-[UBP]-[cytidine deaminase]-COOH;
$NH_2$-[napDNAbp]-[UBP]-[NAP]-[cytidine deaminase]-COOH;
$NH_2$-[napDNAbp]-[UBP]-[cytidine deaminase]-[NAP]-COOH;
$NH_2$-[NAP]-[napDNAbp]-[cytidine deaminase]-[UBP]-COOH;
$NH_2$-[napDNAbp]-[NAP]-[cytidine deaminase]-[UBP]-COOH;
$NH_2$-[napDNAbp]-[cytidine deaminase]-[NAP]-[UBP]-COOH; or
$NH_2$-[napDNAbp]-[cytidine deaminase]-[UBP]-[NAP]-COOH In some embodiments, the fusion proteins comprising a cytidine deaminase, a napDNAbp (e.g., Cas9 domain), a UBP, and NAP do not include a linker sequence. In some embodiments, a linker is present between the cytidine deaminase domain and the napDNAbp, the NAP, and/or the UBP. In some embodiments, a linker is present between the napDNAbp and the cytidine deaminase domain, the NAP, and/or the UBP. In some embodiments, a linker is present between the NAP and the cytidine deaminase, the napDNAbp and/or the UBP. In some embodiments, a linker is present between the UBP and the cytidine deaminase, the napDNAbp, and the NAP. In some embodiments, the "-" used in the general architecture above indicates the presence of an optional linker. In some embodiments, the linker is any of the linkers provided herein, for example, in the section entitled "Linkers". In some embodiments, the linker comprises between 1 and 200 amino acids. In some embodiments, the linker comprises from 1 to 5, 1 to 10, 1 to 20, 1 to 30, 1 to 40, 1 to 50, 1 to 60, 1 to 80, 1 to 100, 1 to 150, 1 to 200, 5 to 10, 5 to 20, 5 to 30, 5 to 40, 5 to 60, 5 to 80, 5 to 100, 5 to 150, 5 to 200, 10 to 20, 10 to 30, 10 to 40, 10 to 50, 10 to 60, 10 to 80, 10 to 100, 10 to 150, 10 to 200, 20 to 30, 20 to 40, 20 to 50, 20 to 60, 20 to 80, 20 to 100, 20 to 150, 20 to 200, 30 to 40, 30 to 50, 30 to 60, 30 to 80, 30 to 100, 30 to 150, 30 to 200, 40 to 50, 40 to 60, 40 to 80, 40 to 100, 40 to 150, 40 to 200, 50 to 60 50 to 80, 50 to 100, 50 to 150, 50 to 200, 60 to 80, 60 to 100, 60 to 150, 60 to 200, 80 to 100, 80 to 150, 80 to 200, 100 to 150, 100 to 200, or 150 to 200 amino acids in length. In some embodiments, linker that comprises 4, 16, 32, or 104 amino acids in length. In some embodiments, the linker that comprises the amino acid sequence of SGSETPGTSESATPES (SEQ ID NO: 102), SGGS (SEQ ID NO: 103), SGGSSGSETPGTSESATPESSGGS (SEQ ID NO: 107), SGGSSGGSSGSETPGTSESATPESSGGSSGGS (SEQ ID NO: 108), GGSGGSPGSPAGSPTSTEEGTSESATPESGPGTSTEPSEGSAPGSPAGSPTSTEEGTSTE PSEGSAPGTSTEPSEGSAPGTSESATPESGPGSEPATSGGSGGS (SEQ ID NO: 109), or SGGSGGSGGS (SEQ ID NO: 120). In some embodiments, the linker comprises the amino acid sequence SGSETPGTSESATPES (SEQ ID NO: 102), which may also be referred to as the XTEN linker.

Fusion Proteins Comprising a Nuclease Programmable DNA Binding Protein (napDNAbp), and a Base Excision Enzyme (BEE)

Some aspects of the disclosure provide fusion proteins comprising a nucleic acid programmable DNA binding protein (napDNAbp), and a base excision enzyme. In some embodiments, any of the fusion proteins provided herein are base editors. In some embodiments, the base excision enzyme (BEE) is a cytosine, thymine, adenine, guanine, or uracil base excision enzyme. In some embodiments, the base excision enzyme (BEE) is a cytosine base excision enzyme. In some embodiments, the BEE is a thymine base excision enzyme. In some embodiments, the base excision enzyme comprises an amino acid sequence that is at least 75%, 80%, 85%, 90%, 95%, 96%, 97%, 98%, 99%, or 99.5% identical to a naturally-occurring BEE. In some embodiments, the base excision enzyme comprises an amino acid sequence that is at least 75%, 80%, 85%, 90%, 95%, 96%, 97%, 98%, 99%, or 99.5% identical any one of SEQ ID NOs: 65-66. In some embodiments, the base excision enzyme comprises the amino acid sequence of any one of SEQ ID NOs: 65-66.

In some embodiments, the napDNAbp is a Cas9 domain, a Cpf1 domain, a CasX domain, a CasY domain, a C2c1 domain, a C2c2 domain, aC2c3 domain, or an Argonaute domain. In some embodiments, the napDNAbp is any napDNAbp provided herein. In some embodiments, the napDNAbp of any of the fusion proteins provided herein is a Cas9 domain. The Cas9 domain may be any of the Cas9 domains or Cas9 proteins (e.g., dCas9 or nCas9) provided herein. In some embodiments, any of the Cas9 domains or Cas9 proteins (e.g., dCas9 or nCas9) provided herein may be fused with any of the cytidine deaminases provided herein. In some embodiments, the fusion protein comprises the structure:

$NH_2$-[BEE]-[napDNAbp]-COOH; or
$NH_2$-[napDNAbp]-[BEE]-COOH;

In some embodiments, the fusion protein further comprises a nucleic acid polymerase (NAP). In some embodiments, the NAP is a eukaryotic nucleic acid polymerase. In some embodiments, the NAP is a DNA polymerase. In some embodiments, the NAP has translesion polymerase activity. In some embodiments, the NAP is a translesion DNA polymerase. In some embodiments, the NAP is a Rev7, Rev1 complex, polymerase iota, polymerase kappa, or polymerase eta. In some embodiments, the NAP is a eukaryotic polymerase alpha, beta, gamma, delta, epsilon, gamma, eta, iota, kappa, lambda, mu, or nu. In some embodiments, the NAP comprises an amino acid sequence that is at least 75%, 80%, 85%, 90%, 95%, 96%, 97%, 98%, 99%, or 99.5% identical to a nucleic acid polymerase (e.g., a translesion DNA polymerase). In some embodiments, the NAP comprises an amino acid sequence that is at least 75%, 80%, 85%, 90%, 95%, 96%, 97%, 98%, 99%, or 99.5% identical to any of the nucleic acid polymerases provided herein. For example, the NAP may comprise an amino acid sequence that is at least 75%, 80%, 85%, 90%, 95%, 96%, 97%, 98%, 99%, or 99.5% identical to any one of SEQ ID NOs: 54-64. In some embodiments, the NAP comprises the amino acid sequence of any one of SEQ ID NOs: 54-64. In some embodiments, the fusion protein comprises the structure:

$NH_2$-[BEE]-[napDNAbp]-[NAP]-COOH;
$NH_2$-[BEE]-[NAP]-[napDNAbp]-COOH;
$NH_2$-[NAP]-[BEE]-[napDNAbp]-COOH;
$NH_2$-[NAP]-[napDNAbp]-[BEE]-COOH;
$NH_2$-[napDNAbp]-[NAP]-[BEE]-COOH; or
$NH_2$-[napDNAbp]-[BEE]-[NAP]-COOH In some embodiments, the fusion proteins comprising a napDNAbp (e.g., Cas9 domain), and a BEE do not include a linker sequence. In some embodiments, the fusion proteins comprising a napDNAbp (e.g., Cas9 domain), a BEE, and a NAP do not include a linker sequence. In some embodiments, a linker is present between the napDNAbp and the BEE. In some embodiments, a linker is present between the BEE and the NAP and/or the napDNAbp. In some embodiments, a linker is present between the NAP and the BEE and/or the napDNAbp. In some embodiments, a linker is present between the napDNAbp and the BEE, and/or the NAP. In some embodiments, the "-" used in the general architecture above indicates the presence of an optional linker. In some embodiments, the linker is any of the linkers provided herein, for example, in the section entitled "Linkers". In some embodiments, the linker comprises between 1 and 200 amino acids. In some embodiments, the linker comprises from 1 to 5, 1 to 10, 1 to 20, 1 to 30, 1 to 40, 1 to 50, 1 to 60, 1 to 80, 1 to 100, 1 to 150, 1 to 200, 5 to 10, 5 to 20, 5 to 30, 5 to 40, 5 to 60, 5 to 80, 5 to 100, 5 to 150, 5 to 200, 10 to 20, 10 to 30, 10 to 40, 10 to 50, 10 to 60, 10 to 80, 10 to 100, 10 to 150, 10 to 200, 20 to 30, 20 to 40, 20 to 50, 20 to 60, 20 to 80, 20 to 100, 20 to 150, 20 to 200, 30 to 40, 30 to 50, 30 to 60, 30 to 80, 30 to 100, 30 to 150, 30 to 200, 40 to 50, 40 to 60, 40 to 80, 40 to 100, 40 to 150, 40 to 200, 50 to 60 50 to 80, 50 to 100, 50 to 150, 50 to 200, 60 to 80, 60 to 100, 60 to 150, 60 to 200, 80 to 100, 80 to 150, 80 to 200, 100 to 150, 100 to 200, or 150 to 200 amino acids in length. In some embodiments, linker that comprises 4, 16, 32, or 104 amino acids in length. In some embodiments, the linker that comprises the amino acid sequence of SGSETPGTSESATPES (SEQ ID NO: 102), SGGS (SEQ ID NO: 103), SGGSSGSETPGTSESATPESSGGS (SEQ ID NO: 107), SGGSSGGSSGSETPGTSESATPESSGGSSGGS (SEQ ID NO: 108), GGSGGSPGSPAGSPTSTEEGTSESATPESGPGTSTEPSEGSAPGSPAGSPTSTEEGTSTE PSEGSAPGTSTEPSEGSAPGTSESATPESGPGSEPATSGGSGGS (SEQ ID NO: 109), or SGGSGGSGGS (SEQ ID NO: 120). In some embodiments, the linker comprises the amino acid sequence SGSETPGTSESATPES (SEQ ID NO: 102), which may also be referred to as the XTEN linker.

Fusion Proteins Comprising a Nuclear Localization Sequence (NLS)

In some embodiments, any of the fusion proteins provided herein further comprise one or more nuclear targeting sequences, for example, a nuclear localization sequence (NLS). In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the napDNAbp. In some embodiments, the NLS is fused to the C-terminus of the napDNAbp. In some embodiments, the NLS is fused to the N-terminus of the NAP. In some embodiments, the NLS is fused to the C-terminus of the NAP. In some embodiments, the NLS is fused to the N-terminus of the cytidine deaminase. In some embodiments, the NLS is fused to the C-terminus of the cytidine deaminase. In some embodiments, the NLS is fused to the N-terminus of the UBP. In some embodiments, the NLS is fused to the C-terminus of the UBP. In some embodiments, the NLS is fused to the N-terminus of the BEE. In some embodiments, the NLS is fused to the C-terminus of the BEE. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. In some embodiments, the NLS comprises an amino acid sequence as set forth in SEQ ID NO: 41 or SEQ ID NO: 42. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, a NLS comprises the amino acid sequence PKKKRKV (SEQ ID NO: 41), MDSLLMNRRKFLYQFKNVRWAKGRRETYLC (SEQ ID NO: 42), KRTADGSEFESPKKKRKV (SEQ ID NO: 43), KRGINDRNFWRGENGRKTR (SEQ ID NO: 44), KKTGGPIYRRVDGKWRR (SEQ ID NO: 45), RRELILYDKEEIRRIWR (SEQ ID NO: 46), or AVSRKRKA (SEQ ID NO: 47).

Linkers

A In certain embodiments, linkers may be used to link any of the proteins or protein domains described herein. The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-110, 110-120, 120-130, 130-140, 140-150, or 150-200 amino acids in length. Longer or shorter linkers are also contemplated. In some embodiments, a linker comprises the amino acid sequence SGSETPGTSESATPES (SEQ ID NO: 102), which may also be referred to as the XTEN linker. In some embodiments, a linker comprises the amino acid sequence SGGS (SEQ ID NO: 103). In some embodiments, a linker comprises $(SGGS)_n$ (SEQ ID NO: 103), (GGGS)n (SEQ ID NO: 104), (GGGGS)n (SEQ ID NO: 105), (G)n (SEQ ID NO: 121), (EAAAK)n (SEQ ID NO: 106), (GGS)n (SEQ ID NO: 122), SGSETPGTSESATPES (SEQ ID NO: 102), SGGSGGSGGS (SEQ ID NO: 120), or $(XP)_n$ motif (SEQ ID NO: 123), or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15. In some embodiments, a linker comprises SGSETPGTSESATPES (SEQ ID NO: 102), and SGGS (SEQ ID NO: 103). In some embodiments, a linker comprises SGGSSGSETPGTSESATPESSGGS (SEQ ID NO: 107). In some embodiments, a linker comprises SGGSSGGSSGSETPGTSESATPESSGGSSGGS (SEQ ID NO: 108). In some embodiments, a linker comprises GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS (SEQ ID NO: 109). In some embodiments, a linker comprises SGGSGGSGGS (SEQ ID NO: 120).

Nucleic Acid Programmable DNA Binding Protein (napDNAbp) Complexes with Guide Nucleic Acids Some aspects of this disclosure provide complexes comprising any of the fusion proteins provided herein, and a guide nucleic acid bound to napDNAbp of the fusion protein. Some aspects of this disclosure provide complexes comprising any of the fusion proteins provided herein, and a guide RNA bound to a Cas9 domain (e.g., a dCas9, a nuclease active Cas9, or a Cas9 nickase) of fusion protein.

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is an RNA sequence. In some embodiments, the target sequence is a sequence in the genome of a mammal. In some embodiments, the target sequence is a sequence in the genome of a human. In some embodiments, the 3' end of the target sequence is immediately adjacent to a canonical PAM sequence (NGG). In some embodiments, the guide nucleic acid (e.g., guide RNA) is complementary to a sequence associated with a disease or disorder. In some embodiments, the guide nucleic acid (e.g., guide RNA) is complementary to a sequence associated with a disease or disorder having a mutation in a gene associated with any of the diseases or disorders provided herein. In some embodiments, the guide nucleic acid (e.g., guide RNA) is complementary to any of the genes associated with a disease or disorder as provided herein.

Methods of Using Fusion Proteins

Some aspects of this disclosure provide methods of using any of the fusion proteins (e.g., base editors) provided herein, or complexes comprising a guide nucleic acid (e.g., gRNA) and a fusion protein (e.g., base editor) provided herein. For example, some aspects of this disclosure provide methods comprising contacting a DNA, or RNA molecule with any of the fusion proteins or base editors provided herein, and with at least one guide nucleic acid (e.g., guide RNA), wherein the guide nucleic acid, (e.g., guide RNA) is about 15-100 nucleotides long and comprises a sequence of at least 10 contiguous nucleotides that is complementary to a target sequence. In some embodiments, the 3' end of the target sequence is immediately adjacent to a canonical spCas9 PAM sequence (NGG). In some embodiments, the 3' end of the target sequence is not immediately adjacent to a spCas9 canonical PAM sequence (NGG). In some embodiments, the 3' end of the target sequence is immediately adjacent to an AGC, GAG, TTT, GTG, or CAA sequence.

In some embodiments, the target DNA sequence comprises a sequence associated with a disease or disorder. In some embodiments, the target DNA sequence comprises a point mutation associated with a disease or disorder. In some embodiments, the activity of the fusion protein (e.g., comprising a napDNAbp, a cytidine deaminase, and a uracil binding protein UBP), or the complex, results in a correction of the point mutation. In some embodiments, the target DNA sequence comprises a G to C, or C to G point mutation associated with a disease or disorder, and wherein deamination and/or excision of a mutant C base results in a sequence that is not associated with a disease or disorder. In some embodiments, the target DNA sequence encodes a protein, and the point mutation is in a codon and results in a change in the amino acid encoded by the mutant codon as compared to the wild-type codon. In some embodiments, the deamination of the mutant C results in a change of the amino acid encoded by the mutant codon. In some embodiments, the deamination of the mutant C results in the codon encoding the wild-type amino acid. In some embodiments, the contacting is in vivo in a subject. In some embodiments, the subject has or has been diagnosed with a disease or disorder. In some embodiments, the disease or disorder is 22q13.3 deletion syndrome; 2-methyl-3-hydroxybutyric aciduria; 3 Methylcrotonyl-CoA carboxylase 1 deficiency; 3-methylcrotonyl CoA carboxylase 2 deficiency; 3-Methylglutaconic aciduria type 2; 3-Methylglutaconic aciduria type 3; 3-methylglutaconic aciduria type V; 3-Oxo-5 alpha-steroid delta 4-dehydrogenase deficiency; 46,XY sex reversal, type 1; 46,XY true hermaphroditism, SRY-related; 4-Hydroxyphenylpyruvate dioxygenase deficiency; Abnormal facial shape; Abnormal glycosylation (CDG IIa); Achondrogenesis type 2; Achromatopsia 2; Achromatopsia 5; Achromatopsia 6; Achromatopsia 7; Acquired hemoglobin H disease; Acrocephalosyndactyly type I; Acrodysostosis 1 with or without hormone resistance; Acrodysostosis 2, with or without hormone resistance; Acrofacial Dysostosis, Cincinnati type; ACTH resistance; Acute neuronopathic Gaucher disease; Adams-Oliver syndrome; Adams-Oliver syndrome 2; Adams-Oliver syndrome 4; Adams-Oliver Syndrome 6; Adenine phosphoribosyltransferase deficiency; Adenylosuccinate lyase deficiency; Adolescent nephronophthisis; Adrenoleukodystrophy; Adult junctional epidermolysis bullosa; Adult neuronal ceroid lipofuscinosis; ADULT syndrome; Age-related macular degeneration 14; Age-related macular degeneration 3; Aicardi Goutieres syndrome 5; Aicardi-goutieres syndrome 6; Alexander disease; alpha Thalassemia; Alpha-B crystallinopathy; Alport syndrome, autosomal recessive; Alport syndrome, X-linked recessive; Alternating hemiplegia of childhood 2; Alzheimer disease; Alzheimer disease, type 1; Alzheimer disease, type 3; Amelogenesis Imperfecta, Hypomaturation type, IIA3; Amelogenesis imperfecta, type 1E; Amish lethal microcephaly; AML—Acute myeloid leukemia; Amyloidogenic transthyretin amyloidosis; Amyotrophic lateral sclerosis 16, juvenile; Amyotrophic lateral sclerosis 6, autosomal recessive; Amyotrophic lateral sclerosis type 1; Amyotrophic lateral sclerosis type 10; Amyotrophic lateral sclerosis type 2; Amyotrophic lateral sclerosis type 9; Andersen Tawil syndrome; Anemia, Dyserythropoietic Congenital, Type IV; Anemia, nonspherocytic hemolytic, due to G6PD deficiency; Anemia, sideroblastic, pyridoxine-refractory, autosomal recessive; Angelman syndrome; Angiopathy, hereditary, with nephropathy, aneurysms, and muscle cramps; Anhidrotic ectodermal dysplasia with immune deficiency; Anonychia; Antley-Bixler syndrome with genital anomalies and disordered steroidogenesis; Antley-Bixler syndrome without genital anomalies or disordered steroidogenesis; Aplastic anemia; Apolipoprotein a-i deficiency; Arginase deficiency; Arrhythmogenic right ventricular cardiomyopathy; Arrhythmogenic right ventricular cardiomyopathy, type 11; Arrhythmogenic right ventricular cardiomyopathy, type 9; Arterial calcification of infancy; Arterial tortuosity syndrome; Arthrogryposis multiplex congenita distal type 1; Arthrogryposis renal dysfunction cholestasis syndrome; Arthrogryposis, distal, type 5d; Arts syndrome; Aspartylglucosaminuria, finnish type; Asphyxiating thoracic dystrophy 2; Ataxia with vitamin E deficiency; Ataxia-telangiectasia syndrome; Ataxia-telangiectasia-like disorder; Atelosteogenesis type 1; Atrial fibrillation; Atrial fibrillation, familial, 10; Atrial septal defect 4; Atrophia bulborum hereditaria; ATR-X syndrome; Atypical hemolytic-uremic syndrome 1; Auditory neuropathy, autosomal recessive, 1; Auriculocondylar syndrome 1; Autoimmune disease, multisystem, infantile-onset; Autoimmune lymphoproliferative syndrome, type 1A; Autoimmune Lymphoproliferative Syndrome, type V; Autosomal dominant nocturnal frontal lobe epilepsy; Autosomal dominant progressive external ophthalmoplegia with mitochondrial DNA deletions 2; Autosomal dominant progressive external ophthalmoplegia with mitochondrial DNA deletions 3; Autosomal dominant progressive external ophthalmoplegia with mitochondrial DNA deletions 4; Autosomal recessive congenital ichthyosis 1; Autosomal recessive congenital ichthyosis 5; Autosomal recessive hypophosphatemic vitamin D refractory rickets; Axenfeld-rieger anomaly; Axenfeld-Rieger syndrome type 1; Axenfeld-Rieger syndrome type 3; Baraitser-Winter syndrome 1; Bardet-Biedl syndrome; Bardet-Biedl syndrome 10; Bardet-Biedl syndrome 12; Bardet-Biedl syndrome 2; Bardet-Biedl syndrome 3; Bardet-Biedl syndrome 4; Bardet-Biedl syndrome 9; Bartter syndrome antenatal type 2; Bartter syndrome, type 4b; Basal ganglia disease, biotin-responsive; Becker muscular dystrophy; Benign familial neonatal seizures 1; Benign familial neonatal-infantile seizures; Benign recurrent intrahepatic cholestasis 2; Bernard-Soulier syndrome, type B; beta Thalassemia; Bietti crystalline corneoretinal dystrophy; Bile acid synthesis defect, congenital, 2; Biotinidase deficiency; Bleeding disorder, platelet-type, 19; Blood Group—Lutheran Inhibitor; Bloom syndrome; Bosley-Salih-Alorainy syndrome; Boucher Neuhauser syndrome; Brachydactyly type B2; Breast cancer; Breast-ovarian cancer, familial 1; Breast-ovarian cancer, familial 2; Bronchiectasis; Brown-Vialetto-Van laere syndrome; Brown-Vialetto-Van Laere syndrome 2; Bullous ichthyosiform erythroderma; Burkitt lymphoma; Camptomelic dysplasia; Cap myopathy 2; Carbohydrate-deficient glycoprotein syndrome type I; Carbohydrate-deficient glycoprotein syndrome type II; Carcinoma of colon; Carcinoma of pancreas; Cardiac arrhythmia; Cardioencephalomyopathy, Fatal Infantile, Due To Cytochrome C Oxidase Deficiency 3; Cardiofaciocutaneous syndrome; Cardiofaciocutaneous syndrome 2; Cardiomyopathy; Cardiomyopathy, restrictive; Carney complex, type 1; Carnitine palmitoyltransferase I deficiency; Cataract 1; Cataracts, congenital, with sensorineural deafness, down syndrome-like facial appearance, short stature, and mental retardation; Catecholaminergic polymorphic ventricular tachycardia; Central core disease; Central precocious puberty; Cerebellar ataxia and hypogonadotropic hypogonadism; Cerebellar ataxia infantile with progressive external ophthalmoplegia; Cerebellar ataxia, deafness, and narcolepsy; Cerebral amyloid angiopathy, APP-related; Cerebral autosomal dominant arteriopathy with subcortical infarcts and leukoencephalopathy; Cerebral cavernous malformations 1; Cerebral palsy, spastic quadriplegic, 1; Cerebro-costo-mandibular syndrome; Ceroid lipofuscinosis neuronal 1; Ceroid lipofuscinosis neuronal 10; Ceroid lipofuscinosis neuronal 6; Ceroid lipofuscinosis neuronal 7; Ceroid lipofuscinosis neuronal 8; Ceroid lipofuscinosis, neuronal, 13; Ceroid lipofuscinosis, neuronal, 2; Ch\xc3\xa9diak-Higashi syndrome; Char syndrome; Charcot-Marie-Tooth disease; Charcot-Marie-Tooth disease type 1B; Charcot-Marie-Tooth disease type 2B; Charcot-Marie-Tooth disease type 2D; Charcot-Marie-Tooth disease type 21; Charcot-Marie-Tooth disease type 2K; Charcot-Marie-Tooth disease, axonal, with vocal cord paresis, autosomal recessive; Charcot-Marie-Tooth Disease, demyelinating, Type 1C; Charcot-Marie-Tooth disease, dominant intermediate E; Charcot-Marie-Tooth disease, type 2; Charcot-Marie-Tooth disease, type 2A2; Charcot-Marie-Tooth disease, type 4C; Charcot-Marie-Tooth disease, type 4G; Charcot-Marie-Tooth disease, type IA; Charcot-Marie-Tooth disease, type IE; Charcot-Marie-Tooth disease, type IF; Charcot-Marie-Tooth disease, X-linked recessive, type 5; CHARGE association; Child syndrome; Cholestanol storage disease; Cholesterol monooxygenase (side-chain cleaving) deficiency; Chondrodysplasia *punctata* 1, X-linked recessive; Chops Syndrome; Chromosome 9q deletion syndrome; Chronic granulomatous disease, X-linked; Ciliary dyskinesia, primary, 14; Ciliary dyskinesia, primary, 19; Ciliary dyskinesia, primary, 3; Ciliary dyskinesia, primary, 7; Cleidocranial dysostosis; Cockayne syndrome type A; Coffin-Lowry syndrome; Cohen syndrome; Cole disease; Colorectal cancer, hereditary, nonpolyposis, type 1; Combined cellular and humoral immune defects with granulomas; Combined oxidative phosphorylation deficiency 24; Combined oxidative phosphorylation deficiency 9; Common variable immunodeficiency 7; Complement component 9 deficiency; Cone-rod dystrophy 10; Cone-rod dystrophy 11; Cone-rod dystrophy 3; Cone-rod dystrophy 5; Cone-rod dystrophy 6; Congenital adrenal hypoplasia, X-linked; Congenital amegakaryocytic thrombocytopenia; Congenital aniridia; Congenital bilateral absence of the vas deferens; Congenital cataracts, hearing loss, and neurodegeneration; Congenital contractural arachnodactyly; Congenital defect of folate absorption; Congenital disorder of glycosylation type 1K; Congenital disorder of glycosylation type 1M; Congenital disorder of glycosylation type 1t; Congenital disorder of glycosylation type 1u; Congenital disorder of glycosylation type 2C; Congenital generalized lipodystrophy type 1; Congenital generalized lipodystrophy type 2; Congenital heart defects, multiple types, 1, X-linked; Congenital lactase deficiency; Congenital long QT syndrome; Congenital muscular dystrophy-dystroglycanopathy with brain and eye anomalies, type A2; Congenital muscular dystrophy-dystroglycanopathy with brain and eye anomalies, type A7; Congenital muscular dystrophy-dystroglycanopathy with mental retardation, type B1; Congenital muscular dystrophy-dystroglycanopathy with mental retardation, type B2; Congenital myopathy with fiber type disproportion; Congenital myotonia, autosomal dominant form; Congenital myotonia, autosomal recessive form; Congenital stationary night blindness, autosomal dominant 3; Congenital stationary night blindness, type 1A; Congenital stationary night blindness, type 1F; Coproporphyria; Corneal dystrophy, Fuchs endothelial, 8; Corneal epithelial dystrophy; Corneal fragility keratoglobus, blue sclerae and joint hypermobility; Cornelia de Lange syndrome 1; Cornelia de Lange syndrome 4; Cortical dysplasia, complex, with other brain malformations 3; Cortisone reductase deficiency 1; Cowden syndrome 2; Cranioectodermal dysplasia 1; Craniofacial deafness hand syndrome; Cranioosteoarthropathy; Craniosynostosis; Craniosynostosis 3; Craniosynostosis and dental anomalies; Creatine deficiency, X-linked; Crigler Najjar syndrome, type 1; Crouzon syndrome; Cryptophthalmos syndrome; Cryptorchidism, unilateral or bilateral; Cushing symphalangism; Cutis Gyrata syndrome of Beare and Stevenson; Cystathioninuria; Cystic fibrosis; Cystinosis, ocular nonnephropathic; Cytochrome-c oxidase deficiency; Danon disease; Deafness, autosomal dominant 12; Deafness, autosomal dominant 20; Deafness, autosomal recessive 1A; Deafness, autosomal recessive 63; Deafness, autosomal recessive 8; Deafness, autosomal recessive 9; Deficiency of acetyl-CoA acetyltransferase; Deficiency of alpha-mannosidase; Deficiency of ferroxidase; Deficiency of glycerol kinase; Deficiency of guanidinoacetate methyltransferase; Deficiency of hydroxymethylglutaryl-CoA lyase; Deficiency of iodide peroxidase; Deficiency of malonyl-CoA decarboxylase; Deficiency of UDPglucose-hexose-1-phosphate uridylyltransferase; Delayed speech and language development; delta Thalassemia; Dent disease 1; Desbuquois syndrome; Desmosterolosis; DFNA 2 Nonsyndromic Hearing Loss; Diabetes mellitus type 2; Diabetes mellitus, insulin-dependent, 20; Digitorenocerebral syndrome; Dilated cardiomyopathy 1FF; Dilated cardiomyopathy 1G; Dilated cardiomyopathy 1S; Dilated cardiomyopathy 1X; Dilated cardiomyopathy 3B; Disordered steroidogenesis due to cytochrome p450 oxidoreductase deficiency; Distal hereditary motor neuronopathy type 2B; Distichiasis-lymphedema syndrome; Drash syndrome; Duchenne muscular dystrophy; Dyskeratosis congenita autosomal dominant; Dyskeratosis congenita X-linked; Dyskeratosis congenita, autosomal dominant, 2; Dyskeratosis congenita, autosomal recessive, 5; Dystonia 1; DYSTONIA 27; Dystonia 5, Dopa-responsive type; Dystonia, dopa-responsive, with or without hyperphenylalaninemia, autosomal recessive; Early infantile epileptic encephalopathy 13; Early infantile epileptic encephalopathy 2; Early infantile epileptic encephalopathy 8; Early infantile epileptic encephalopathy 9; Early myoclonic encephalopathy; Ectodermal dysplasia-syndactyly syndrome 1; Ectrodactyly, ectodermal dysplasia, and cleft lip/palate syndrome 3; Ehlers-Danlos syndrome, classic type; Ehlers-Danlos syndrome, hydroxylysine-deficient; Ehlers-Danlos syndrome, musculocontractural type; Ehlers-Danlos syndrome, type 4; Eichsfeld type congenital muscular dystrophy; Elliptocytosis 3; Endometrial carcinoma; Endplate acetylcholinesterase deficiency; Enlarged vestibular aqueduct syndrome; Enterokinase deficiency; Epidermolysis bullosa simplex, Koebner type; Epilepsy, nocturnal frontal lobe, type 3; Epilepsy, progressive myoclonic 1A (Unverricht and Lundborg); Epilepsy, progressive myoclonic 2b; Epileptic encephalopathy, early infantile, 1; Epileptic encephalopathy, early infantile, 24; Epileptic encephalopathy, early infantile, 28; Epileptic Encephalopathy, Early Infantile, 31; Epiphyseal chondrodysplasia, miura type; Episodic ataxia type 1; Episodic ataxia, type 6; Episodic pain syndrome, familial, 3; Erythrocytosis, familial, 2; Erythrocytosis, familial, 3; Erythrokeratodermia with ataxia; Exudative vitreoretinopathy 1; Exudative vitreoretinopathy 5; Fabry disease; Fabry disease, cardiac variant; Factor v and factor viii, combined deficiency of, 2; Familial amyloid nephropathy with urticaria AND deafness; Familial cancer of breast; Familial cold urticaria; Familial febrile seizures 8; Familial hemiplegic migraine type 3; Familial hypertrophic cardiomyopathy 1; Familial hypertrophic cardiomyopathy 10; Familial hypertrophic cardiomyopathy 11; Familial hypertrophic cardiomyopathy 20; Familial hypertrophic cardiomyopathy 23; Familial hypertrophic cardiomyopathy 4; Familial hypertrophic cardiomyopathy 6; Familial hypoplastic, glomerulocystic kidney; Familial infantile myasthenia; Familial juvenile gout; Familial Mediterranean fever; Familial platelet disorder with associated myeloid malignancy; Familial porencephaly; Familial *porphyria* cutanea *tarda*; Familial visceral amyloidosis, Ostertag type; Fanconi anemia, complementation group C; Fanconi anemia, complementation group F; Fanconi anemia, complementation group G; Fanconi anemia, complementation group J; Fanconi Anemia, complementation group T; Farber lipogranulomatosis; Fetal hemoglobin quantitative trait locus 1; Fetal hemoglobin quantitative trait locus 6; Fibrochondrogenesis; Focal epilepsy with speech disorder with or without mental retardation; Focal segmental glomerulosclerosis 6; Foveal hypoplasia and presenile cataract syndrome; Frontonasal dysplasia 1; Frontonasal dysplasia 2; Frontotemporal dementia; Fructose-biphosphatase deficiency; Fumarase deficiency; Galactosylceramide beta-galactosidase deficiency; Gallbladder disease 4; Gamstorp-Wohlfart syndrome; Ganglioside sialidase deficiency; Gangliosidosis GM1 type 3; Gardner syndrome; GATA-1-related thrombocytopenia with dyserythropoiesis; Gaucher disease; Gaucher disease type 3C; Gaucher disease, perinatal lethal; Gaucher disease, type 1; Generalized epilepsy with febrile seizures plus, type 1; Generalized epilepsy with febrile seizures plus, type 2; Generalized epilepsy with febrile seizures plus, type 9; Gerstmann-Straussler-Scheinker syndrome; Glanzmann thrombasthenia; Glaucoma 1, open angle, F; Glaucoma, congenital; Global developmental delay; Glucocorticoid deficiency 4; Glutaric aciduria, type 1; Glycogen storage disease Ma; Glycogen storage disease IV, congenital neuromuscular; Glycogen storage disease IXb; Glycogen storage disease of heart, lethal congenital; Glycogen storage disease, type II; Glycogen storage disease, type IV; Glycogen storage disease, type V; Glycogen storage disease, type VI; Glycosylphosphatidylinositol deficiency; Gray platelet syndrome; Griscelli syndrome type 2; Growth and mental retardation, mandibulofacial dysostosis, microcephaly, and cleft palate; Growth hormone insensitivity with immunodeficiency; Hemochromatosis type 1; Hemochromatosis type 3; Hemolytic anemia due to hexokinase deficiency; Hemolytic anemia, nonspherocytic, due to glucose phosphate isomerase deficiency; Hemosiderosis, systemic, due to aceruloplasminemia; Hennekam lymphangiectasia-lymphedema syndrome; Hereditary acrodermatitis enteropathica; Hereditary angioedema type 1; Hereditary breast and ovarian cancer syndrome; Hereditary cancer-predisposing syndrome; Hereditary diffuse gastric cancer; Hereditary diffuse leukoencephalopathy with spheroids; Hereditary factor II deficiency disease; Hereditary factor IX deficiency disease; Hereditary factor VIII deficiency disease; Hereditary factor XI deficiency disease; Hereditary fructosuria; Hereditary leiomyomatosis and renal cell cancer; Hereditary lymphedema type I; Hereditary neuralgic amyotrophy;

Hereditary nonpolyposis colorectal cancer type 5; Hereditary Nonpolyposis Colorectal Neoplasms; Hereditary pancreatitis; Hereditary Paraganglioma-Pheochromocytoma Syndromes; Hereditary pyropoikilocytosis; Hereditary sensory neuropathy type 1D; Hereditary sideroblastic anemia; Heterotaxy, visceral, X-linked; Heterotopia; Hirschsprung disease ganglioneuroblastoma; Histiocytic medullary reticulosis; Holoprosencephaly 11; Holoprosencephaly 2; Holoprosencephaly 3; Holoprosencephaly 4; Homocysteinemia due to MTHFR deficiency; Homocystinuria due to CBS deficiency; Hurler syndrome; Hurthle cell carcinoma of thyroid; Hutchinson-Gilford syndrome; Hypercalciuria, childhood, self-limiting; Hypercholesterolaemia; Hyperekplexia 3; Hyperekplexia hereditary; Hyperferritinemia cataract syndrome; Hyperlipoproteinemia, type I; Hyperlipoproteinemia, type ID; Hyperlysinemia; Hyperornithinemia-hyperammonemia-homocitrullinuria syndrome; Hyperproinsulinemia; Hypertelorism, severe, with midface prominence, myopia, mental retardation, and bone fragility; Hypertrophic cardiomyopathy; Hypocalcemia, autosomal dominant 1; Hypocalcemia, autosomal dominant 1, with bartter syndrome; Hypochondroplasia; Hypochromic microcytic anemia with iron overload; Hypoglycemia with deficiency of glycogen synthetase in the liver; Hypogonadotropic hypogonadism 13 with or without anosmia; Hypohidrotic X-linked ectodermal dysplasia; Hypokalemic periodic paralysis 1; Hypomagnesemia 1, intestinal; Hypomagnesemia 5, renal, with ocular involvement; Hypomagnesemia, seizures, and mental retardation; Hypomyelinating leukodystrophy 7; Hypomyelinating leukodystrophy 8, with or without oligodontia and/or hypogonadotropic hypogonadism; Hypoproteinemia, hypercatabolic; Hypothyroidism, congenital, nongoitrous, 1; Hypothyroidism, congenital, nongoitrous, 5; Hypothyroidism, congenital, nongoitrous, 6; Hypotrichosis 6; Hypotrichosis-lymphedema-telangiectasia syndrome; I cell disease; Ichthyosis vulgaris; Idiopathic basal ganglia calcification 5; Immunodeficiency 12; Immunodeficiency 23; Immunodeficiency 24; Immunodeficiency 30; Immunodeficiency 31a; Immunodeficiency 31C; Immunodeficiency with hyper IgM type 1; Inclusion body myopathy 2; Infantile cerebellar-retinal degeneration; Infantile GM1 gangliosidosis; Infantile hypophosphatasia; Infantile nystagmus, X-linked; Insulin-resistant diabetes mellitus AND acanthosis *nigricans*; Intellectual disability; Intermediate maple syrup urine disease type 2; Invasive pneumococcal disease, recurrent isolated, 2; Irido-corneo-trabecular dysgenesis; Iron accumulation in brain; Jackson-Weiss syndrome; Jakob-Creutzfeldt disease; Joubert syndrome 23; Juvenile GM>1<gangliosidosis; Juvenile polyposis syndrome; Kabuki make-up syndrome; Kallmann syndrome 3; Kallmann syndrome 4; Kallmann syndrome 5; Kallmann syndrome 6; Keratoconus 1; Kohlschutter syndrome; Kugelberg-Welander disease; Lafora disease; Langer mesomelic dysplasia syndrome; Laron-type isolated somatotropin defect; Larsen syndrome, dominant type; Lchad deficiency with maternal acute fatty liver of pregnancy; Leber congenital amaurosis 13; Leber congenital amaurosis 4; Leber congenital amaurosis 9; Leigh disease; LEOPARD syndrome; LEOPARD syndrome 1; LEOPARD syndrome 2; Leprechaunism syndrome; Leri Weill dyschondrosteosis; Lesch-Nyhan syndrome; Leukodystrophy, hypomyelinating, 6; Leukoencephalopathy with ataxia; Leukoencephalopathy with Brainstem and Spinal Cord Involvement and Lactate Elevation; Leukoencephalopathy with vanishing white matter; Leydig cell agenesis; Li-Fraumeni syndrome 1; Limb-girdle muscular dystrophy; Limb-girdle muscular dystrophy, type 1B; Limb-girdle muscular dystrophy, type 1C; Limb-girdle muscular dystrophy, type 1E; Limb-girdle muscular dystrophy, type 2A; Limb-girdle muscular dystrophy, type 2B; Limb-girdle muscular dystrophy, type 2E; Limb-girdle muscular dystrophy, type 2F; Limb-girdle muscular dystrophy, type 2L; Limb-girdle muscular dystrophy-dystroglycanopathy, type C1; Limb-girdle muscular dystrophy-dystroglycanopathy, type C14; Limb-girdle muscular dystrophy-dystroglycanopathy, type C2; Limb-girdle muscular dystrophy-dystroglycanopathy, type C7; Lissencephaly 1; Long QT syndrome 1; Long QT syndrome 13; Long QT syndrome 15; Long QT syndrome 2; Long QT syndrome 9; Long QT syndrome, LQT1 subtype; Long-chain 3-hydroxyacyl-CoA dehydrogenase deficiency; Lowe syndrome; Luteinizing hormone resistance, female; Lymphoproliferative syndrome 1; Lymphoproliferative syndrome 1, X-linked; Lynch syndrome I; Lynch syndrome II; Macrothrombocytopenia, familial, Bernard-Soulier type; Macular dystrophy with central cone involvement; Majeed syndrome; Malignant tumor of esophagus; Malignant tumor of prostate; Mandibuloacral dysostosis; Maple syrup urine disease; Maple syrup urine disease type 1A; Maple syrup urine disease type 2; Marfan syndrome; Marie Unna hereditary hypotrichosis 1; Maturity-onset diabetes of the young, type 2; Maturity-onset diabetes of the young, type 3; Medium-chain acyl-coenzyme A dehydrogenase deficiency; Meier-Gorlin syndrome 5; Melnick-Fraser syndrome; MEN2 phenotype: Unclassified; MEN2 phenotype: Unknown; Menkes kinky-hair syndrome; Menopause, natural, age at, quantitative trait locus 3; Mental retardation 30, X-linked; Mental retardation and microcephaly with pontine and cerebellar hypoplasia; Mental retardation, autosomal dominant 13; Mental retardation, autosomal dominant 16; Mental retardation, autosomal dominant 29; Mental Retardation, Autosomal Dominant 38; Mental retardation, autosomal dominant 7; Mental retardation, autosomal recessive 34; Mental Retardation, Autosomal Recessive 49; Mental retardation, stereotypic movements, epilepsy, and/or cerebral malformations; Mental retardation, syndromic, Claes-Jensen type, X-linked; Mental retardation, X-linked, syndromic 13; Mental retardation, X-linked, syndromic 32; Mental retardation, X-linked, syndromic, raymond type; Mental retardation, X-linked, syndromic, wu type; Mental retardation-hypotonic facies syndrome X-linked, 1; Merosin deficient congenital muscular dystrophy; Metachromatic leukodystrophy; Metaphyseal chondrodysplasia, Schmid type; Methylcobalamin Deficiency, cblg type; Methylmalonic Aciduria, mut(0) type; Microcephaly and chorioretinopathy, autosomal recessive, 2; Microcephaly with or without chorioretinopathy, lymphedema, or mental retardation; Microcytic anemia; Micropenis; Microphthalmia syndromic 3; Microphthalmia syndromic 5; Microphthalmia, isolated 3; Microphthalmia, isolated 6; Microphthalmia, isolated, with coloboma 7; Microvascular complications of diabetes 7; Mild non-PKU hyperphenylalanemia; Mitochondrial complex I deficiency; Mitochondrial complex II deficiency; Mitochondrial complex III deficiency; Mitochondrial DNA depletion syndrome 13 (encephalomyopathic type); Mitochondrial DNA depletion syndrome 2; Mitochondrial DNA depletion syndrome 9 (encephalomyopathic with methylmalonic aciduria); Mitochondrial Short-Chain Enoyl-CoA Hydratase 1 Deficiency; Mitochondrial trifunctional protein deficiency; Miyoshi muscular dystrophy 1; Miyoshi muscular dystrophy 3; Mohr-Tranebjaerg syndrome; Mosaic variegated aneuploidy syndrome; Mowat-Wilson syndrome; Mucolipidosis III Gamma; Mucopolysaccharidosis type VI; Mucopolysaccharidosis, MPS-II; Mucopolysaccharidosis, MPS-III-B; Mucopolysaccharidosis, MPS-I-S; Mucopolysaccharidosis, MPS- IV-A; Mucopolysaccharidosis, MPS-IV-B; Muenke syndrome; Mulibrey nanism syndrome; Multiple congenital anomalies; Multiple endocrine neoplasia, type 1; Multiple endocrine neoplasia, type 2; Multiple endocrine neoplasia, type 2a; Multiple epiphyseal dysplasia 1; Multiple epiphyseal dysplasia 5; Multiple exostoses type 2; Multiple pterygium syndrome Escobar type; Multiple sulfatase deficiency; Mutilating keratoderma; Myasthenia, limb-girdle, familial; Myasthenic syndrome, congenital, 9, associated with acetylcholine receptor deficiency Myasthenic Syndrome, Congenital, 9, Associated With Acetylcholine Receptor Deficiency; Myasthenic syndrome, congenital, with pre- and postsynaptic defects; Myasthenic syndrome, congenital, with tubular aggregates 2; Myasthenic syndrome, slow-channel congenital; Myoclonic epilepsy myopathy sensory ataxia; Myoclonus, familial cortical; Myofibrillar myopathy 1; Myokymia 1; Myopathy with postural muscle atrophy, X-linked; Myopathy, actin, congenital, with excess of thin myofilaments; Myopathy, centronuclear; Myopathy, distal, 1; Myopathy, isolated mitochondrial, auto somal dominant; Myopathy, reducing body, X-linked, early-onset, severe; Myotonia congenita; Nail disorder, nonsyndromic congenital, 8; Nanophthalmos 4; Narcolepsy 7; Native American myopathy; Navajo neurohepatopathy; Nemaline myopathy 3; Neonatal hypotonia; Neonatal insulin-dependent diabetes mellitus; Neonatal intrahepatic cholestasis caused by citrin deficiency; Neoplasm of ovary; Nephrolithiasis/osteoporosis, hypophosphatemic, 2; Nephronophthisis 16; Nephronophthisis 18; Nephrotic syndrome, type 10; Neu-Laxova syndrome 1; Neurodegeneration with brain iron accumulation 5; Neurohypophyseal diabetes insipidus; Nicolaides-Baraitser syndrome; Niemann-Pick disease type C1; Niemann-Pick disease, type A; Niemann-Pick disease, type B; Niemann-Pick Disease, type c1, juvenile form; Nonaka myopathy; Non-ketotic hyperglycinemia; Noonan syndrome 1; Noonan syndrome 5; Noonan syndrome 7; Noonan syndrome 8; not provided; not specified; Oculocutaneous albinism type 3; Oculopharyngeal muscular dystrophy; Opsismodysplasia; Optic atrophy 9; Optic atrophy and cataract, autosomal dominant; Optic nerve hypoplasia and abnormalities of the central nervous system; Oral-facial-digital syndrome; Ornithine aminotransferase deficiency; Ornithine carbamoyltransferase deficiency; Orofacial cleft 11; Orofaciodigital syndrome 6; Orotic aciduria; Osteogenesis imperfecta type 12; Osteogenesis imperfecta type 13; Osteogenesis imperfecta type III; Osteogenesis imperfecta with normal sclerae, dominant form; Osteogenesis imperfecta, recessive perinatal lethal; Osteopetrosis autosomal dominant type 1; Osteopetrosis autosomal recessive 7; Oto-palato-digital syndrome, type I; Pachydermoperiostosis syndrome; Pallister-Hall syndrome; Papillon-Lef\xc3\xa8vre syndrome; Paragangliomas 1; Paragangliomas 4; Parathyroid carcinoma; Parietal foramina 2; Parkinson disease 1; Parkinson disease 7; Parkinson disease 9; Paroxysmal nocturnal hemoglobinuria 1; Partial hypoxanthine-guanine phosphoribosyltransferase deficiency; Peeling skin syndrome, acral type; Pelger-Hu\xc3\xabt anomaly; Pelizaeus-Merzbacher disease; Pendred syndrome; Permanent neonatal diabetes mellitus; Peroxisome biogenesis disorder 6B; Peroxisome biogenesis disorder 9B; Peutz-Jeghers syndrome; Pfeiffer syndrome; Phenylketonuria; Pheochromocytoma; Phosphoglycerate kinase 1 deficiency; Phosphoribosylpyrophosphate synthetase superactivity; Photosensitive trichothiodystrophy; Pierson syndrome; Pigmentary pallidal degeneration; Pitt-Hopkins syndrome; Pitt-Hopkins-like syndrome 2; Pituitary dependent hypercortisolism; Pituitary hormone deficiency, combined 1; Pituitary hormone deficiency, combined 4; Pituitary hormone deficiency, combined 5; Platelet-type bleeding disorder 16; Polyagglutinable erythrocyte syndrome; Polyarteritis nodosa; Polycystic kidney disease, infantile type; Polyglucosan body myopathy 2; Polymicrogyria, bilateral frontoparietal; Polyneuropathy, hearing loss, ataxia, retinitis pigmentosa, and cataract; Pontocerebellar hypoplasia, type 1B; Pontocerebellar hypoplasia, type 1c; Pontocerebellar hypoplasia, type 9; Poretti-boltshauser syndrome; Preaxial polydactyly 2; Premature chromatid separation trait; Premature ovarian failure 5; Premature ovarian failure 7; Premature ovarian failure 9; Primary autosomal recessive microcephaly 1; Primary autosomal recessive microcephaly 2; Primary autosomal recessive microcephaly 5; Primary autosomal recessive microcephaly 6; Primary ciliary dyskinesia; Primary dilated cardiomyopathy; Primary familial hypertrophic cardiomyopathy; Primary hyperoxaluria, type I; Primary hyperoxaluria, type III; Primary localized cutaneous amyloidosis 1; Primary open angle glaucoma juvenile onset 1; Primary pulmonary hypertension; Primary pulmonary hypertension 4; Primrose syndrome; Progressive myositis ossificans; Progressive sclerosing poliodystrophy; Proliferative vasculopathy and hydranencephaly-hydrocephaly syndrome; Properdin deficiency, X-linked; Propionic acidemia; Pseudo-Hurler polydystrophy; Pseudohypoaldosteronism type 1 autosomal dominant; Pseudohypoaldosteronism type 2B; Pseudohypoaldosteronism, type 2; Pseudohypoparathyroidism type 1A; Pseudoxanthoma elasticum; Pseudoxanthoma elasticum-like disorder with multiple coagulation factor deficiency; Pulmonary arterial hypertension related to hereditary hemorrhagic telangiectasia; Pulmonary Fibrosis And/Or Bone Marrow Failure, Telomere-Related, 2; Pyknodysostosis; Pyridoxine-dependent epilepsy; Pyruvate dehydrogenase E1-alpha deficiency; Radial aplasia-thrombocytopenia syndrome; Raine syndrome; Rasopathy; Recessive dystrophic epidermolysis bullosa; Reifenstein syndrome; Renal carnitine transport defect; Renal cell carcinoma, papillary, 1; Renal dysplasia; Renal hypouricemia 2; Renal tubular acidosis, distal, with hemolytic anemia; Retinal cone dystrophy 3A; Retinitis pigmentosa; Retinitis pigmentosa 10; Retinitis pigmentosa 11; Retinitis pigmentosa 14; Retinitis pigmentosa 2; Retinitis pigmentosa 25; Retinitis pigmentosa 33; Retinitis pigmentosa 35; Retinitis pigmentosa 4; Retinitis pigmentosa 43; Retinitis pigmentosa 50; Retinitis pigmentosa 56; Retinitis Pigmentosa 73; Retinitis Pigmentosa 74; Retinoblastoma; Rett disorder; Rett syndrome, congenital variant; Rett syndrome, zappella variant; Rhabdoid tumor predisposition syndrome 2; Rhizomelic chondrodysplasia *punctata* type 1; Rienhoff syndrome; Roberts-SC phocomelia syndrome; Robinow syndrome; RRM2B-related mitochondrial disease; Rubinstein-Taybi syndrome; Saethre-Chotzen syndrome; Scapuloperoneal myopathy, X-linked dominant; Schindler disease, type 1; Schindler disease, type 3; Schnyder crystalline corneal dystrophy; Seckel syndrome 1; Seizures; Selective tooth agenesis 1; Senior-Loken Syndrome 8; Sensory ataxic neuropathy, dysarthria, and ophthalmoparesis; SeSAME syndrome; Severe combined immunodeficiency due to ADA deficiency; Severe combined immunodeficiency with microcephaly, growth retardation, and sensitivity to ionizing radiation; Severe congenital neutropenia; Severe congenital neutropenia 4, autosomal recessive; Severe myoclonic epilepsy in infancy; Severe X-linked myotubular myopathy; short QT syndrome; Short QT syndrome 2; Short Stature With Nonspecific Skeletal Abnormalities; Short stature, auditory canal atresia, mandibular hypoplasia, skeletal abnormalities; Short stature, idiopathic, autosomal; Short stature, idiopathic, X-linked; Short-Rib Thoracic Dysplasia 13 With Or Without Polydactyly; Short-rib thoracic dysplasia 14 with polydactyly; Short-rib thoracic dysplasia 3 with or without polydactyly; Shprintzen syndrome; Shprintzen-Goldberg syndrome; Shwachman syndrome; Sialic acid storage disease, severe infantile type; Sialidosis, type II; Sick sinus syndrome 2, autosomal dominant; Sideroblastic anemia with B-cell immunodeficiency, periodic fevers, and developmental delay; Sitosterolemia; Sj\xc3\xb6gren-Larsson syndrome; Smith-Lemli-Opitz syndrome; Sorsby fundus dystrophy; Sotos syndrome 1; Sotos syndrome 2; Spastic ataxia Charlevoix-Saguenay type; Spastic paraplegia 11, autosomal recessive; Spastic paraplegia 30, autosomal recessive; Spastic paraplegia 4, autosomal dominant; Spastic paraplegia 54, autosomal recessive; Spastic paraplegia 6; Spastic paraplegia 7; Spastic paraplegia 8; Spermatogenic failure 8; Spherocytosis type 4; Sphingolipid activator protein 1 deficiency; Sphingomyelin/cholesterol lipidosis; Spinal muscular atrophy, lower extremity predominant 2, autosomal dominant; Spinal muscular atrophy, type II; Spinocerebellar ataxia 14; Spinocerebellar ataxia 21; Spinocerebellar ataxia 35; Spinocerebellar ataxia 38; Spinocerebellar ataxia, autosomal recessive 12; Spondylocostal dysostosis 2; Spondyloepimetaphyseal dysplasia with joint laxity; Spondyloepimetaphyseal dysplasia, pakistani type; Spondyloepiphyseal dysplasia congenita; Spondylometaphyseal dysplasia with cone-rod dystrophy; Squamous cell carcinoma of the head and neck; Stargardt disease 1; Stargardt Disease 3; Steel syndrome; Stickler syndrome type 1; Stiff skin syndrome; Sting-associated vasculopathy, infantile-onset; Subacute neuronopathic Gaucher disease; Succinyl-CoA acetoacetate transferase deficiency; Superoxide dismutase, elevated extracellular; Supravalvar aortic stenosis; Symphalangism-brachydactyly syndrome; Syndactyly type 9; Tangier disease; Tarsal carpal coalition syndrome; Tay-Sachs disease; Tay-Sachs disease, B1 variant; T-cell prolymphocytic leukemia; Temple-Baraitser syndrome; Temtamy preaxial brachydactyly syndrome; Tetralogy of Fallot; Thoracic aortic aneurysms and aortic dissections; Thrombocytopenia 2; Thrombocytopenia, X-linked; Thrombocytopenia, X-linked, intermittent; Thrombophilia due to activated protein C resistance; Thrombophilia, hereditary, due to protein C deficiency, autosomal dominant; Thrombophilia, hereditary, due to protein C deficiency, autosomal recessive; Thyroid Cancer, Nonmedullary, 4; Thyroid dyshormonogenesis 1; Thyrotoxic periodic paralysis; Tietz syndrome; Tooth agenesis, selective, 3; Tooth agenesis, selective, X-linked, 1; Transient neonatal diabetes mellitus 1; Transient neonatal diabetes mellitus 2; Treacher collins syndrome 2; Trichorhinophalangeal dysplasia type I; Triglyceride storage disease with ichthyosis; Triosephosphate isomerase deficiency; Triphalangeal thumb; Tuberous sclerosis 1; Tuberous sclerosis 2; Tuberous sclerosis syndrome; Tyrosinase-negative oculocutaneous albinism; Tyrosinase-positive oculocutaneous albinism; Tyrosinemia type 2; Ullrich congenital muscular dystrophy; Unclassifed; Unverricht-Lundborg syndrome; Upshaw-Schulman syndrome; Uridine 5-prime monophosphate hydrolase deficiency, hemolytic anemia due to; Usher syndrome, type 1D; Usher syndrome, type 1F; Usher syndrome, type 2A; Van der Woude syndrome; Variegate *porphyria*; Vater association with macrocephaly and ventriculomegaly; Ventricular septal defect 3; Vitamin D-dependent rickets, type 1; Vitamin D-dependent rickets, type 2; Vitamin k-dependent clotting factors, combined deficiency of, 1; Vitelliform dystrophy; Von Hippel-Lindau syndrome; von Willebrand disease, type 2b; Waardenburg syndrome type 1; Waardenburg syndrome type 2E, without neurologic involvement; Waardenburg syndrome type 4A; Waardenburg syndrome type 4B; Waardenburg syndrome type 4C; Walker-Warburg congenital muscular dystrophy; Warburg micro syndrome 3; Warts, hypogammaglobulinemia, infections, and myelokathexis; Werdnig-Hoffmann disease; Werner syndrome; Wieacker syndrome; Wiedemann-Steiner syndrome; Winchester syndrome; Wolfram syndrome 2; Xerocytosis; Xeroderma pigmentosum, group D; Xeroderma pigmentosum, group G; X-linked agammaglobulinemia; X-linked hereditary motor and sensory neuropathy; X-linked ichthyosis with steryl-sulfatase deficiency; X-Linked Mental Retardation 41; X-Linked mental retardation 90; X-linked periventricular heterotopia; Zimmermann-Laband syndrome; or Zimmermann-Laband syndrome 2.

In some embodiments, the target DNA sequence comprises a sequence associated with a disease or disorder. In some embodiments, the target DNA sequence comprises a point mutation associated with a disease or disorder. In some embodiments, the point mutation associated with a disease or disorder is in a gene associated with the disease or disorder. In some embodiments, the gene associated with the disease or disorder is selected from the group consisting of AARS2, AASS, ABCA1, ABCA4, ABCB11, ABCB6, ABCC6, ABCC8, ABCD1, ABCG8, ABHD12, ABHD5, ACADM, ACAT1, ACE, ACO2, ACTA1, ACTB, ACTG1, ACTN2, ACVR1, ACVRL1, ADA, ADAMTS13, ADAR, ADGRG1, ADSL, AFF4, AGA, AGBL1, AGL, AGPAT2, AGRN, AGXT, AIPL1, AKR1D1, ALAD, ALAS2, ALDH3A2, ALDH7A1, ALDOB, ALG1, ALPL, ALS2, ALX3, ALX4, AMPD2, AMT, ANKS6, ANO5, APC, APOA1, APOE, APP, APRT, AQP2, AR, ARHGEF9, ARID2, ARL6, ARSA, ARSB, ARSE, ARX, ASAH1, ASB10, ASPM, ATF6, ATL1, ATM, ATP13A2, ATP1A3, ATP6V1B2, ATP7A, ATR, ATRX, AVP, B2M, B3GALT6, BAAT, BARD1, BBS10, BBS12, BBS2, BBS4, BBS9, BCKDHA, BCKDHB, BCS1L, BEST1, BHLHA9, BICD2, BLM, BMP1, BMP4, BMPR2, BRAF, BRCA1, BRCA2, BRIP1, BTD, BTK, C10orf2, C1GALT1C1, C5orf42, C9, CA1, CACNA1S, CALM2, CANT1, CAPN3, CASK, CASQ2, CASR, CAV3, CBS, CCBE1, CCDC39, CD40LG, CDC6, CDC73, CDH1, CDH23, CDKL5, CDKN2A, CDON, CECR1, CENPJ, CEP120, CEP83, CFP, CFTR, CHAT, CHCHD10, CHD7, CHRNA1, CHRNB2, CHRNG, CHST14, CHSY1, CLCN1, CLCN2, CLCN5, CLCNKA, CLDN16, CLDN19, CLIC2, CLN6, CLN8, CNGA3, CNNM2, CNTNAP2, COA5, COL11A1, COL1A1, COL1A2, COL27A1, COL2A1, COL3A1, COL4A1, COL4A5, COL5A1, COL5A2, COL6A1, COL6A3, COL7A1, COLQ, COMP, CP, CPOX, CPT1A, CPT2, CR2, CRADD, CREBBP, CRH, CRX, CRYAB, CSF1R, CSTB, CTH, CTLA4, CTNS, CTPS1, CTSC, CTSD, CTSF, CTSK, CUL3, CXCR4, CYBB, CYP1B1, CYP27A1, CYP27B1, CYP4F22, CYP4V2, CYP7B1, DARS2, DBT, DCLRE1C, DCX, DDHD2, DES, DGUOK, DHCR24, DHCR7, DKC1, DLG3, DLL4, DMD, DMP1, DNAH11, DNAH5, DNAJB6, DNAJC19, DNM1, DNM2, DNMT1, DOCK6, DOK7, DOLK, DPAGT1, DPM2, DSC2, DSP, DYNC1H1, DYNC2H1, DYRK1A, DYSF, ECEL1, ECHS1, EDA, EDN3, EEF1A2, EFHC1, EFTUD2, EGLN1, EHMT1, EIF2B5, ELN, ELOVL4, ELOVL5, EMP2, ENPP1, EOGT, ERCC2, ERCC8, ESCO2, ETFDH, EXOSC3, EXOSC8, EXT2, EYA1, EYS, F12, F2, F5, F8, F9, FAM20C, FANCA, FANCF, FANCG, FAS, FBLN5, FBN1, FBN2, FBP1, FBXL4, FCGR3B, FGF8, FGFR1, FGFR2, FGFR3, FH, FHL1, FKTN, FLCN, FLG, FLNA, FLNB, FLT4, FLVCR2, FOXC1, FOXE1, FOXG1, FOXL2, FRAS1, FRMD7, FTL, FUS, G6PC3, G6PD, GAA, GABRA1, GABRG2, GAD1, GALC, GALNS, GALT, GAMT, GARS, GATA1, GATA6, GBA, GBA2, GBE1, GCDH, GCH1, GCK, GDAP1, GDI1, GFAP, GGCX, GHR, GJA8, GJB1, GJB2, GK, GLB1, GLI3, GLRA1, GMPPB, GNAI3, GNAS, GNAT1, GNE, GNPTAB, GNPTG, GPI, GPIHBP1, GPT2, GRIA3, GRIN2A, GRIN2B, GRIP1, GRN, GSC, GUCY2D, GYG1, GYS2, H6PD, HADHB, HBB, HBD, HBG1, HBG2, HCN1, HCN4, HESX1, HEXA, HFE, HFM1, HGSNAT, HINT1, HK1, HMGCL, HNF1A, HNF1B, HOGA1, HOXA1, HPD, HPGD, HPRT1, HR, HSD17B10, HSPB1, IDS, IDUA, IFT122, IFT80, IGHMBP2, IKBKG, IL11RA, IL12RB1, IMPDH1, IMPG2, INF2, ING1, INPPL1, INSL3, INSR, IRF6, IRX5, ISPD, ITGA2B, ITGB3, ITK, JAGN1, KCNA1, KCNH1, KCNH2, KCNJ1, KCNJ10, KCNJ11, KCNJ18, KCNJ2, KCNJ5, KCNK3, KCNQ1, KCNQ2, KCNQ4, KDM5C, KIAA0196, KIAA0586, KIF11, KIF1A, KIF2A, KISS1, KISS1R, KLF1, KMT2A, KMT2D, KRAS, KRIT1, KRT1, KRT5, KRT6A, *LAMA*1, *LAMA*2, LAMB2, LAMB3, LAMP2, LBR, LCT, LDLR, LIPA, LITAF, LMBR1, LMNA, LPIN2, LPL, LRIT3, LRP5, LRRC6, LRTOMT, LYST, LYZ, MAD1L1, MAF, MALT1, MAN2B1, MAPK1, MASTL, MATN3, MC2R, MCCC1, MCCC2, MCFD2, MCM8, MCOLN1, MCPH1, MECP2, MEF2C, MEFV, MEN1, MESP2, MET, MFN2, MFSD8, MGAT2, MITF, MKKS, MLH1, MLYCD, MMACHC, MMP14, MOG, MPL, MPV17, MPZ, MRE11A, MRPL3, MSH2, MSH6, MSR1, MSX1, MT-ATP6, MTHFR, MTM1, MT-ND1, MTR, MUSK, MUT, MYBPC3, MYC, MYH7, MYL2, MYL3, MYO1E, MYOC, NAGA, NAGLU, NARS2, NBEAL2, NBN, NDP, NDUFA1, NDUFA13, NDUFAF3, NDUFS8, NEFL, NEU1, NEXN, NFIX, NHEJ1, NHLRC1, NIPA1, NIPBL, NKX2-5, NLRP3, NMNAT1, NNT, NOBOX, NOG, NOL3, NOTCH3, NPC1, NPR2, NR0B1, NR3C2, NR5A1, NRXN1, NSD1, NSDHL, NT5C3A, NYX, OAT, OCA2, OCRL, OFD1, OPA3, OPCML, OSMR, OTC, OTOF, OTX2, OXCT1, PAFAH1B1, PAH, PAK3, PALB2, PANK2, PAPSS2, PARK7, PAX2, PAX3, PAX6, PAX9, PCCA, PCCB, PCDH15, PCDH19, PCYT1A, PDE4D, PDE6A, PDE6B, PDE6C, PDE6H, PDGFB, PDHA1, PET100, PEX10, PEX7, PGK1, PGM1, PGM3, PHGDH, PHKB, PHOX2B, PIEZO1, PIGM, PITPNM3, PITX2, PKHD1, PKP2, PLA2G6, PLK4, PLOD1, PLP1, PMM2, PMP22, PMS2, PNPLA6, POLG, POLG2, POLR1A, POLR1D, POLR3A, POLR3B, POMT1, POMT2, POR, POU1F1, PPDX, PPT1, PRKACG, PRKAG2, PRKAR1A, PRKCG, PRNP, PROC, PROK2, PROKR2, PRPF31, PRPS1, PRSS56, PSAP, PSEN1, PTEN, PTPN11, PURA, PVRL4, PYGL, PYGM, RAB18, RAB27A, RAB7A, RAD21, RAD51C, RAF1, RAG2, RAX, RAX2, RB1, RBM8A, RDH12, RET, RHO, RIT1, RNF216, ROGDI, RP2, RPGR, RPS6KA3, RRM2B, RSPO4, RUNX1, RUNX2, RYR1, RYR2, SACS, SAMHD1, SBDS, SCN11A, SCN1A, SCN2A, SCN5A, SCN8A, SCNN1B, SDHAF1, SDHB, SDHD, SEMA4A, SEPN1, SERPINF1, SERPING1, SETBP1, SGCB, SGCD, SH2D1A, SH3TC2, SHANK3, SHH, SHOX, SIGMAR1, SIX3, SKI, SLC11A2, SLC17A5, SLC19A3, SLC1A3, SLC22A5, SLC25A13, SLC25A15, SLC25A19, SLC25A22, SLC25A38, SLC25A4, SLC26A4, SLC2A10, SLC2A9, SLC33A1, SLC35C1, SLC39A4, SLC46A1, SLC4A1, SLC52A2, SLC52A3, SLC5A5, SLC6A5, SLC6A8, SLC9A3R1, SMAD2, SMAD4, SMARCA2, SMARCA4, SMN1, SMPD1, SNCA, SNRNP200, SNRPB, SOD1, SOD3, SOX9, SPAST, SPATA5, SPG11, SPG7, SPTB, SRD5A2, SRY, STAC3, STAR, STAT1, STAT3, STAT5B, STK11, STS, STX1B, STXBP1, SUCLG1, SUMF1, TARDBP, TAZ, TBC1D24, TBX1, TBX20, TCF12, TCF4, *TECTA*, TERC, TERT, TFAP2B, TFR2, TGFB3, TGFBI, TGFBR2, TGIF1, TGM1, TGM5, TGM6, THRA, THRB, TIMM8A, TK2, TMEM173, TMEM240, TMEM98, TMPRSS15, TMPRSS3, TMPRSS6, TNFRSF11A, TNNI3, TNNT1, TOR1A, TP53, TP63, TPI1, TPM1, TPM2, TPM3, TPO, TPP1, TRIM37, TRNT1, TRPM6, TRPS1, TSC1, TSC2, TSHR, TSPAN12, TTPA, TTR, TUBB4A, TULP1, TYMP, TYR, TYRP1, UBE2T, UBE3A, UBIAD1, UMOD, UMPS, UROD, USH2A, USP8, VDR, VHL, VPS13B, VPS33B, VWF, WAS, WDR19, WDR45, WDR62, WDR72, WFS1, WNK4, WNT5A, WRN, WT1, WWOX, ZBTB20, ZC4H2, ZDHHC9, ZEB2, ZFP57, ZIC3, or ZNF469.

Some embodiments provide methods for using the DNA editing fusion proteins provided herein. In some embodiments, the fusion protein is used to introduce a point mutation into a nucleic acid by deaminating a target nucleobase, e.g., a C residue. In some embodiments, the fusion protein is used to deaminate a target C to U, which is then removed to create an abasic site previously occupied by the C residue. In some embodiments, the deamination of the target nucleobase results in the correction of a genetic defect, e.g., in the correction of a point mutation that leads to a loss of function in a gene product. In some embodiments, the methods provided herein are used to introduce a deactivating point mutation into a gene or allele that encodes a gene product that is associated with a disease or disorder. For example, in some embodiments, methods are provided herein that employ a DNA editing fusion protein to introduce a deactivating point mutation into an oncogene (e.g., in the treatment of a proliferative disease). A deactivating mutation may, in some embodiments, generate a premature stop codon in a coding sequence, which results in the expression of a truncated gene product, e.g., a truncated protein lacking the function of the full-length protein.

In some embodiments, the purpose of the methods provided herein is to restore the function of a dysfunctional gene via genome editing. The nucleobase editing proteins provided herein can be validated for gene editing-based human therapeutics in vitro, e.g., by correcting a disease-associated mutation in human cell culture. It will be understood by the skilled artisan that the nucleobase editing proteins provided herein, e.g., the fusion proteins comprising a nucleic acid programmable DNA binding protein (e.g., Cas9), a cytidine deaminase, and a uracil binding protein can be used to correct any single point C to G or G to C mutation. In the first case, deamination of the mutant C to U, and subsequent excision of the U, corrects the mutation, and in the latter case, deamination of the C to U, and subsequent excision of the U that is base-paired with the mutant G, followed by a round of replication, corrects the mutation.

The successful correction of point mutations in disease-associated genes and alleles opens up new strategies for gene correction with applications in therapeutics and basic research. Site-specific single-base modification systems like the disclosed fusion proteins comprising a nucleic acid programmable DNA binding protein (napDNAbp), a cytidine deaminase, and a uracil binding protein also have applications in “reverse” gene therapy, where certain gene functions are purposely suppressed or abolished. In these cases, site-specifically mutating residues that lead to inactivating mutations in a protein, or mutations that inhibit function of the protein can be used to abolish or inhibit protein function in vitro, ex vivo, or in vivo.

The instant disclosure provides methods for the treatment of a subject diagnosed with a disease associated with or caused by a point mutation that can be corrected by a DNA editing fusion protein provided herein. For example, in some embodiments, a method is provided that comprises administering to a subject having such a disease, e.g., a cancer associated with a point mutation as described above, an effective amount of a base editor fusion protein that corrects the point mutation (e.g., a C to G or G to C point mutation) or introduces a deactivating mutation into a disease-associated gene. In some embodiments, the disease is a proliferative disease. In some embodiments, the disease is a genetic disease. In some embodiments, the disease is a neoplastic disease. In some embodiments, the disease is a metabolic disease. In some embodiments, the disease is a lysosomal storage disease. Other diseases that can be treated by correcting a point mutation or introducing a deactivating mutation into a disease-associated gene will be known to those of skill in the art, and the disclosure is not limited in this respect.

The instant disclosure provides lists of genes comprising pathogenic G to C or C to G mutations. Such pathogenic G to C or C to G mutations may be corrected using the methods and compositions provided herein, for example by mutating the C to a G, and/or the G to a C, thereby restoring gene function.

In some embodiments, a fusion protein recognizes canonical PAMs and therefore can correct the pathogenic G to C or C to G mutations with canonical PAMs, e.g., NGG, respectively, in the flanking sequences. For example, Cas9 proteins that recognize canonical PAMs comprise an amino acid sequence that is at least 80%, 85%, 90%, 95%, 97%, 98%, or 99% identical to the amino acid sequence of *Streptococcus pyogenes* Cas9 as provided by SEQ ID NO: 6, or to a fragment thereof comprising the RuvC and HNH domains of SEQ ID NO: 6.

It will be apparent to those of skill in the art that in order to target any of the fusion proteins provided herein, comprising a napDNAbp (e.g., a Cas9 domain), to a target site, e.g., a site comprising a point mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein. In some embodiments, the guide RNA comprises a structure 5'-[guide sequence]-guuuuagagcua-gaaauagcaaguuaaaauaaaggcuaguccguuaucaac-uugaaaaaguggcaccgagucggugcuu uuu-3' (SEQ ID NO: 119), wherein the guide sequence comprises a sequence that is complementary to the target sequence. In some embodiments, the guide sequence comprises a nucleic acid sequence that is complementary to a target nucleic acid. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited.

Base Editor Efficiency

Some aspects of the disclosure are based on the recognition that any of the base editors provided herein are capable of modifying a specific nucleotide base without generating a significant proportion of indels. An "indel", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate or deaminate) a specific nucleotide within a nucleic acid, without generating a large number of insertions or deletions (i.e., indels) in the nucleic acid. In certain embodiments, any of the base editors provided herein are capable of generating a greater proportion of intended modifications (e.g., point mutations or deaminations) versus indels. In some embodiments, the base editors provided herein are capable of generating a ratio of intended point mutations to indels that is greater than 1:1. In some embodiments, the base editors provided herein are capable of generating a ratio of intended point mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. The number of intended mutations and indels may be determined using any suitable method, for example the methods used in the below Examples. In some embodiments, to calculate indel frequencies, sequencing reads are scanned for exact matches to two 10-bp sequences that flank both sides of a window in which indels might occur. If no exact matches are located, the read is excluded from analysis. If the length of this indel window exactly matches the reference sequence the read is classified as not containing an indel. If the indel window is two or more bases longer or shorter than the reference sequence, then the sequencing read is classified as an insertion or deletion, respectively.

In some embodiments, the base editors provided herein are capable of limiting formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, an number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Some aspects of the disclosure are based on the recognition that any of the base editors provided herein are capable of efficiently generating an intended mutation, such as a point mutation, in a nucleic acid (e.g. a nucleic acid within a genome of a subject) without generating a significant number of unintended mutations, such as unintended point mutations. In some embodiments, an intended mutation is a mutation that is generated by a specific base editor bound to a gRNA, specifically designed to generate the intended mutation. In some embodiments, the intended mutation is a mutation associated with a disease or disorder. In some embodiments, the intended mutation is a cytosine (C) to guanine (G) point mutation associated with a disease or disorder. In some embodiments, the intended mutation is a guanine (G) to cytosine (C) point mutation associated with a disease or disorder. In some embodiments, the intended mutation is a cytosine (C) to guanine (G) point mutation within the coding region of a gene. In some embodiments, the intended mutation is a Guanine (G) to cytosine (C) point mutation within the coding region of a gene. In some embodiments, the intended mutation is a point mutation that generates a stop codon, for example, a premature stop codon within the coding region of a gene. In some embodiments, the intended mutation is a mutation that eliminates a stop codon. In some embodiments, the intended mutation is a mutation that alters the splicing of a gene. In some embodiments, the intended mutation is a mutation that alters the regulatory sequence of a gene (e.g., a gene promotor or gene repressor). In some embodiments, any of the base editors provided herein are capable of generating a ratio of intended mutations to unintended mutations (e.g., intended point mutations:unintended point mutations) that is greater than 1:1. In some embodiments, any of the base editors provided herein are capable of generating a ratio of intended mutations to unintended mutations (e.g., intended point mutations:unintended point mutations) that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more. It should be appreciated that the characteristics of the base editors described in the "Base Editor Efficiency" section, herein, may be applied to any of the fusion proteins, or methods of using the fusion proteins provided herein.

Methods for Editing Nucleic Acids

Some aspects of the disclosure provide methods for editing a nucleic acid. In some embodiments, the method is a method for editing a nucleobase of a nucleic acid (e.g., a base pair of a double-stranded DNA sequence). In some embodiments, the method comprises the steps of: a) contacting a target region of a nucleic acid (e.g., a double-stranded DNA sequence) with a complex comprising a base editor (e.g., a Cas9 domain fused to a cytidine deaminase and a uracil binding protein) and a guide nucleic acid (e.g., gRNA), wherein the target region comprises a targeted nucleobase pair, b) inducing strand separation of said target region, c) converting a first nucleobase of said target nucleobase pair in a single strand of the target region to a second nucleobase, d) excising the second nucleobase, thereby creating an abasic site, and e) replacing a third nucleobase complementary to the first nucleobase base with a fourth nucleobase that is a cytosine (C). In some embodiments, the method results in less than 20% indel formation in the nucleic acid. It should be appreciated that in some embodiments, step b is omitted. In some embodiments, the first nucleobase is a cytosine (C). In some embodiments, the second nucleobase is a deaminated cytosine, or uracil. In some embodiments, the third nucleobase is a guanine (G). In some embodiments, the fourth nucleobase is a cytosine (C). In some embodiments, a fifth nucleobase is ligated into the abasic site generated in step (d). In some embodiments the fifth nucleobase is guanine (G). In some embodiments, the method results in less than 19%, 18%, 16%, 14%, 12%, 10%, 8%, 6%, 4%, 2%, 1%, 0.5%, 0.2%, or less than 0.1% indel formation. In some embodiments, at least 5% of the intended base pairs are edited. In some embodiments, at least 10%, 15%, 20%, 25%, 30%, 35%, 40%, 45%, or 50% of the intended base pairs are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the base editor comprises nickase activity. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein. In some embodiments, a target window is a deamination window.

In some embodiments, the disclosure provides methods for editing a nucleotide. In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) excising the second nucleobase, thereby creating an abasic site, and e) replacing a third nucleobase complementary to the first nucleobase base with a fourth nucleobase that is a cytosine (C), thereby generating an intended edited base pair, wherein the efficiency of generating the intended edited base pair is at least 5%. It should be appreciated that in some embodiments, step b is omitted. In some embodiments, at least 5% of the intended base pairs are edited. In some embodiments, at least 10%, 15%, 20%, 25%, 30%, 35%, 40%, 45%, or 50% of the intended base pairs are edited. In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand is hybridized to the guide nucleic acid. In some embodiments, the nucleobase editor comprises nickase activity. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

Pharmaceutical Compositions

Other aspects of the present disclosure relate to pharmaceutical compositions comprising any of the base editors, fusion proteins, or the fusion protein-gRNA complexes described herein. The term "pharmaceutical composition", as used herein, refers to a composition formulated for pharmaceutical use. In some embodiments, the pharmaceutical composition further comprises a pharmaceutically acceptable carrier. In some embodiments, the pharmaceutical composition comprises additional agents (e.g. for specific delivery, increasing half-life, or other therapeutic compounds).

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.). Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) C2-C12 alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

In some embodiments, the pharmaceutical composition is formulated for delivery to a subject, e.g., for gene editing. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump may be used (see, e.g., Langer, 1990, *Science* 249:1527-1533; Sefton, 1989, CRC Crit. Ref. Biomed. Eng. 14:201; Buchwald et al., 1980, *Surgery* 88:507; Saudek et al., 1989, *N. Engl. J. Med.* 321:574). In another embodiment, polymeric materials can be used. (See, e.g., *Medical Applications of Controlled Release* (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, *Macromol. Sci. Rev. Macromol. Chem.* 23:61. See also Levy et al., 1985, *Science* 228:190; During et al., 1989, *Ann. Neurol.* 25:351; Howard et al., 1989, *J. Neurosurg.* 71:105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical compositions for administration by injection are solutions in sterile isotonic aqueous buffer. Where necessary, the pharmaceutical can also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration may be a liquid, e.g., sterile saline, lactated Ringer's or Hank's solution. In addition, the pharmaceutical composition can be in solid forms and re-dissolved or suspended immediately prior to use. Lyophilized forms are also contemplated.

The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et al., *Gene Ther.* 1999, 6:1438-47). Positively charged lipids such as N-[1-(2,3-dioleoyloxi)propyl]-N,N,N-trimethyl-amoniummethylsulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein may be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention (e.g., a fusion protein or a base editor) in lyophilized form and (b) a second container containing a pharmaceutically acceptable diluent (e.g., sterile water) for injection. The pharmaceutically acceptable diluent can be used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers may be formed from a variety of materials such as glass or plastic. In some embodiments, the container holds a composition that is effective for treating a disease described herein and may have a sterile access port. For example, the container may be an intravenous solution bag or a vial having a stopper pierceable by a hypodermic injection needle. The active agent in the composition is a compound of the invention. In some embodiments, the label on or associated with the container indicates that the composition is used for treating the disease of choice. The article of manufacture may further comprise a second container comprising a pharmaceutically-acceptable buffer, such as phosphate-buffered saline, Ringer's solution, or dextrose solution. It may further include other materials desirable from a commercial and user standpoint, including other buffers, diluents, filters, needles, syringes, and package inserts with instructions for use.

Kits, Vectors, Cells

Some aspects of this disclosure provide kits comprising a nucleic acid construct, comprising (a) a nucleotide sequence encoding any of the fusion protein as provided herein; and (b) a heterologous promoter that drives expression of the sequence of (a). In some embodiments, the kit further comprises an expression construct encoding a guide RNA backbone, wherein the construct comprises a cloning site positioned to allow the cloning of a nucleic acid sequence identical or complementary to a target sequence into the guide RNA backbone.

Some aspects of this disclosure provide polynucleotides encoding a napDNAbp (e.g., Cas9 protein) of a fusion protein as provided herein. Some aspects of this disclosure provide vectors comprising such polynucleotides. In some embodiments, the vector comprises a heterologous promoter driving expression of polynucleotide.

Some aspects of this disclosure provide cells comprising any of the fusion proteins provided herein, a nucleic acid molecule encoding any of the fusion proteins provided herein, a complex comprising any of the fusion proteins provided herein and a gRNA, and/or any of the vectors provided herein.

The description of exemplary embodiments of the reporter systems above is provided for illustration purposes only and not meant to be limiting. Additional reporter systems, e.g., variations of the exemplary systems described in detail above, are also embraced by this disclosure.

EXAMPLES

Figure 2:
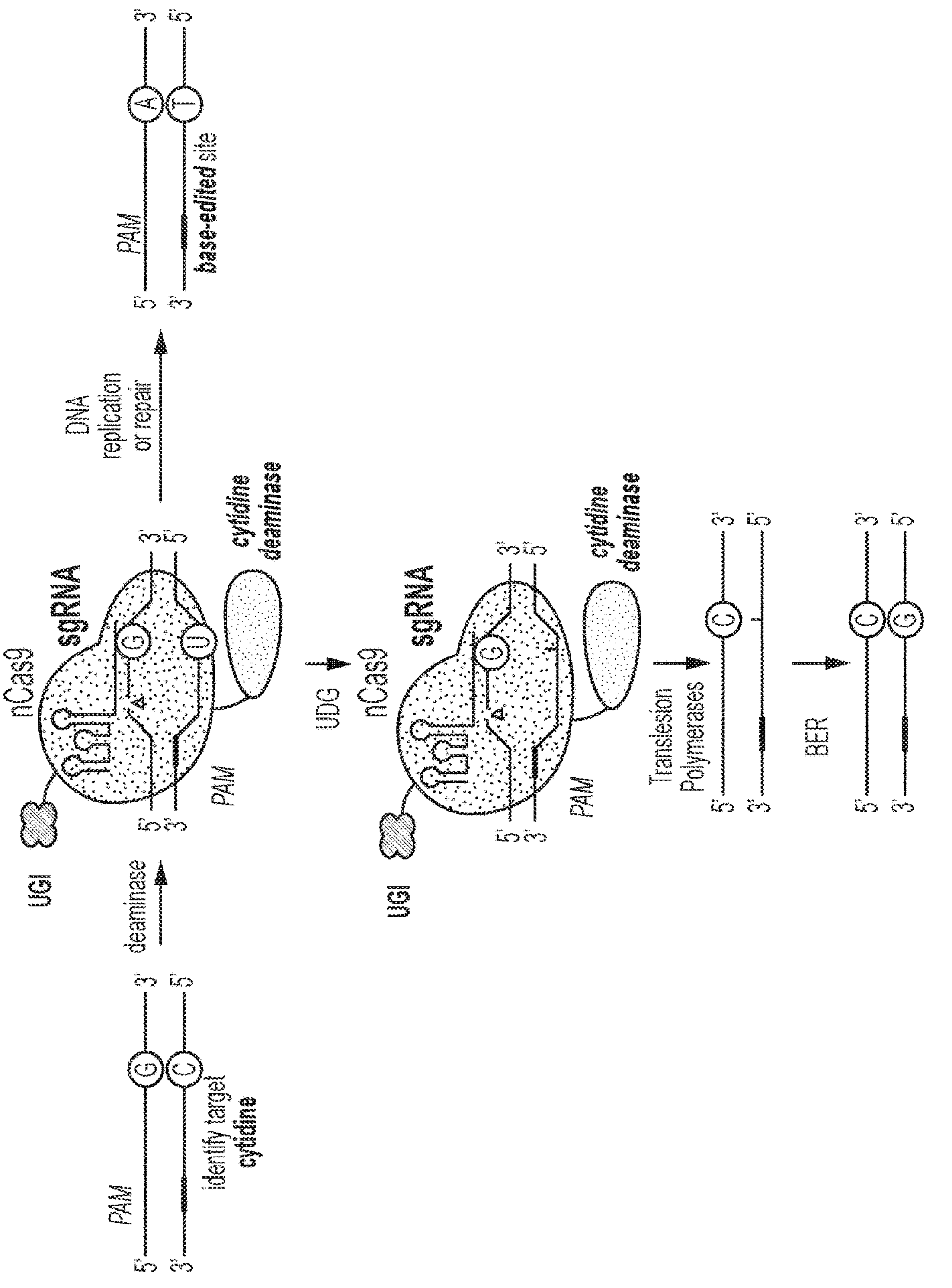
FIG. 2 shows a general schematic illustrating base editing via abasic site generation and base-specific repair for C to G editing.

Cytosine (C) to Guanine (G) Base Editors Through Abasic Site Generation and Engineered Specific Repair Sequencing data for the HEK2, RNF2, and FANCF sites is given below. Data presented represents base editing values for the most edited C in the window. This is C6 for HEK2, C6 for RNF2, and C6 for FANCF. The sequences for the three different sites before and after base editing are as follows: HEK2: GAACACAAAGCATAGACTGC (SEQ ID NO: 110) (sequencing reads CTTGTGTTTCGTATCTGACG (SEQ ID NO: 111)); RNF2: GTCATCTTAGTCATTACCTG (SEQ ID NO: 112) (sequencing reads CAGTAGAATCAGTAATGGAC (SEQ ID NO: 113)); and FANCF: GGAATCCCTTCTGCAGCACC (SEQ ID NO: 114) (sequencing reads the same). For both HEK2 and RNF2, the non-target strand was sequenced (this strand contains G's complementary to the target C's). For FANCF the target strand was sequenced (this strand contains the target C's). A schematic for C to T base editing (e.g., using BE3, which is a C to T base editor) and C to G base editing is shown in FIGS. 1 and 2. Certain DNA polymerases are known to replace bases opposite abasic sites with G. One strategy to achieve C to G base editing is to induce the creation of the abasic site, then recruit or tether such a polymerase to replace the G opposite the abasic site with a C. This could provide access to all editors, if C and T can be excised and repaired with all the polymerases based on the polymerases' predetermined base preferences.

Different fusion constructs are summarized below and are shown in Table 1. UdgX is an isoform of UDG known to bind tightly to uracil with minimal uracil-excision activity. UdgX* is a mutated version of UdgX (Sang et al. NAR, 2015) that was observed to lack uracil excision activity by an in vitro assay in Sang et al. UdgX_On is another mutated version of UdgX (Sang et al. NAR, 2015) observed to have an increased uracil excision activity in the same in vitro assay reported in Sang et al. UDG is the enzyme responsible for the excision of uracil from DNA to create an abasic site. Rev7 is a component of the Rev1/Rev3/Rev7 complex known to incorporate C opposite an abasic site. Rev1 is the enzymatic component of the above mentioned complex. Polymerases Alpha, Beta, Gamma, Delta, Epsilon, Gamma, Eta, Iota, Kappa, Lambda, Mu, and Nu are eukaryotic polymerases with different preferences for base incorporation opposite an abasic site.

TABLE 1

Construct Reference Key

| Construct | Definition |
|---|---|
| BE3 | Published base editing construct |
| BE3_UdgX | UGI replaced with Uracil binding protein, UdgX |
| BE3_UdgX* | UGI replaced with UdgX isoform with diminished binding affinity to Uracil |
| BE3_REV7 | UGI replaced with a component of C-integrating translesion synthesis machinery |
| BE2_UDG | dCas9 based construct (no nicking) where UGI is replaced with uracil deglycosylase |
| BE3_UDG | UGI is replaced with uracil deglycosylase (BE3) |
| BE2_UdgX_On | dCas9 construct where UGI is replaced with UdgX with an activating mutation that increases Uracil excision |
| BE3_UdgX_On | UGI replaced with UdgX with an activating mutation that increases Uracil excision |
| SMUG1 | UGI replaced with SMUG1, a ssDNA uracil deglycosylase |

Constructs Used in the Examples:

BE3_Full Length—This is a C to T base editor construct comprising a cytidine deaminase, a nCas9, and a uracil glycosylase inhibitor (UGI) domain.

(SEQ ID NO: 115)

```
MSSETGPVAVDPTLRRRIEPHEFEVFFDPRELRKETCLLYEINWGGRHS
IWRHTSQNTNKHVEVNFIEKFTTERYFCPNTRCSITWFLSWSPCGECSR
AITEFLSRYPHVTLFIYIARLYHHADPRNRQGLRDLISSGVTIQIMTEQ
ESGYCWRNFVNYSPSNEAHWPRYPHLWVRLYVLELYCIILGLPPCLNIL
RRKQPQLTFFTIALQSCHYQRLPPHILWATGLKSGSETPGTSESATPES
DKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFH
RLEESFLVEEDKKHERHPIFGNIVDEVAYHEKYPTIYHLRKKLVDSTDK
ADLRLIYLALAHMIKFRGHFLIEGDLNPDNSDVDKLFIQLVQTYNQLFE
ENPINASGVDAKAILSARLSKSRRLENLIAQLPGEKKNGLFGNLIALSL
GLTPNFKSNFDLAEDAKLQLSKDTYDDDLDNLLAQIGDQYADLFLAAKN
LSDAILLSDILRVNTEITKAPLSASMIKRYDEHHQDLTLLKALVRQQLP
EKYKEIFFDQSKNGYAGYIDGGASQEEFYKFIKPILEKMDGTEELLVKL
NREDLLRKQRTFDNGSIPHQIHLGELHAILRRQEDFYPFLKDNREKIEK
```

-continued

```
ILTFRIPYYVGPLARGNSRFAWMTRKSEETITPWNFEEVVDKGASAQSF
IERMTNFDKNLPNEKVLPKHSLLYEYFTVYNELTKVKYVTEGMRKPAFL
SGEQKKAIVDLLFKTNRKVTVKQLKEDYFKKIECFDSVETSGVEDRFNA
SLGTYHDLLKIIKDKDFLDNEENEDILEDIVLTLTLFEDREMIEERLKT
YAHLFDDKVMKQLKRRRYTGWGRLSRKLINGIRDKQSGKTILDFLKSDG
FANRNFMQLIHDDSLTFKEDIQKAQVSGQGDSLHEHIANLAGSPAIKKG
ILQTVKVVDELVKVMGRHKPENIVIEMARENQTTQKGQKNSRERMKRIE
EGIKELGSQILKEHPVENTQLQNEKLYLYYLQNGRDMYVDQELDINRLS
DYDVDHIVPQSFLKDDSIDNKVLTRSDKNRGKSDNVPSEEVVKKMKNYW
RQLLNAKLITQRKFDNLTKAERGGLSELDKAGFIKRQLVETRQITKHVA
QILDSRMNTKYDENDKLIREVKVITLKSKLVSDFRKDFQFYKVREINNY
HHAHDAYLNAVVGTALIKKYPKLESEFVYGDYKVYDVRKMIAKSEQEIG
KATAKYFFYSNIMNFFKTEITLANGEIRKRPLIETNGETGEIVWDKGRD
FATVRKVLSMPQVNIVKKTEVQTGGFSKESILPKRNSDKLIARKKDWDP
KKYGGFDSPTVAYSVLVVAKVEKGKSKKLKSVKELLGITIMERSSFEKN
PIDFLEAKGYKEVKKDLIIKLPKYSLFELENGRKRMLASAGELQKGNEL
ALPSKYVNFLYLASHYEKLKGSPEDNEQKQLFVEQHKHYLDEIIEQISE
FSKRVILADANLDKVLSAYNKHRDKPIREQAENIIHLFTLTNLGAPAAF
KYFDTTIDRKRYTSTKEVLDATLIHQSITGLYETRIDLSQLGGDSGGST
NLSDIIEKETGKQLVIQESILMLPEEVEEVIGNKPESDILVHTAYDEST
DENVMLLTSDAPEYKPWALVIQDSNGENKIKMLSGGSPKKKRKV
```

BE3_No UGI—This construct is the above BE3 construct, lacking the UGI domain.

(SEQ ID NO: 116)

```
MSSETGPVAVDPTLRRRIEPHEFEVFFDPRELRKETCLLYEINWGGRHS
IWRHTSQNTNKHVEVNFIEKFTTERYFCPNTRCSITWFLSWSPCGECSR
AITEFLSRYPHVTLFIYIARLYHHADPRNRQGLRDLISSGVTIQIMTEQ
ESGYCWRNFVNYSPSNEAHWPRYPHLWVRLYVLELYCIILGLPPCLNIL
RRKQPQLTFFTIALQSCHYQRLPPHILWATGLKSGSETPGTSESATPES
DKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFH
RLEESFLVEEDKKHERHPIFGNIVDEVAYHEKYPTIYHLRKKLVDSTDK
ADLRLIYLALAHMIKFRGHFLIEGDLNPDNSDVDKLFIQLVQTYNQLFE
ENPINASGVDAKAILSARLSKSRRLENLIAQLPGEKKNGLFGNLIALSL
GLTPNFKSNFDLAEDAKLQLSKDTYDDDLDNLLAQIGDQYADLFLAAKN
LSDAILLSDILRVNTEITKAPLSASMIKRYDEHHQDLTLLKALVRQQLP
EKYKEIFFDQSKNGYAGYIDGGASQEEFYKFIKPILEKMDGTEELLVKL
NREDLLRKQRTFDNGSIPHQIHLGELHAILRRQEDFYPFLKDNREKIEK
ILTFRIPYYVGPLARGNSRFAWMTRKSEETITPWNFEEVVDKGASAQSF
IERMTNFDKNLPNEKVLPKHSLLYEYFTVYNELTKVKYVTEGMRKPAFL
```

-continued

SGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKT

YAHLFDDKVMKQLKRRRYTGWGRLSRKLINGIRDKQSGKTILDFLKSDG

FANRNFMQLIHDDSLTFKEDIQKAQVSGQGDSLHEHIANLAGSPAIKKG

ILQTVKVVDELVKVMGRHKPENIVIEMARENQTTQKGQKNSRERMKRIE

EGIKELGSQILKEHPVENTQLQNEKLYLYYLQNGRDMYVDQELDINRLS

DYDVDHIVPQSFLKDDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKN

PIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKRYTSTKEVLDATLIHQSITGLYETRIDLSQLGGD

Cas9 Nickase Sequence—Used in BE3.

(SEQ ID NO: 21)

MDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

-continued

IVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKRYTSTKEVLDATLIHQSITGLYETRIDLSQLGGD dCas9 Sequence—Used in BE2

(SEQ ID NO: 22)

MDKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNG

SIPHQIHLGELHAILRRQEDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGRHKPENIVIEMAR

ENQTTQKGQKNSRERMKRIEEGIKELGSQILKEHPVENTQLQNEKLYLYYL

QNGRDMYVDQELDINRLSDYDVDAIVPQSFLKDDSIDNKVLTRSDKNRGKS

DNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

IVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSS

FEKNPIDFLEAKGYKEVKKDLIIKLPKYSLFELENGRKRMLASAGELQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTIDRKRYTSTKEVLDATLIHQSITGLYETRIDLSQLGGD

BE3_Replace UGI with UDG, UdgX variants, Polymerases—In the below construct, the NLS sequence is identified by underlining and linkers are identified in italics. The "[UGI]" indicated in the sequence below identifies the location where UDG, UDG variants (e.g., UDG, UdgX* (R107S), and UdgX_On (H109S)), Rev7, and Smug1, were inserted (rather than the UGI of BE3). The "[Polymerase]" indicated in the sequence below identifies the location where polymerases (e.g., Pol Beta, Pol Lambda, Pol Eta, Pol Mu, Pol Iota, Pol Kappa, Pol Alpha, Pol Delta, Pol Gamma, and Pol Nu), and Rev1 were inserted.

(SEQ ID NO: 117)

MSSETGPVAVDPTLRRRIEPHEFEVFFDPRELRKETCLLYEINWGGRHSI
WRHTSQNTNKHVEVNFIEKFTTERYFCPNTRCSITWFLSWSPCGECSRAI
TEFLSRYPHVTLFIYIARLYHHADPRNRQGLRDLISSGVTIQIMTEQESG
YCWRNFVNYSPSNEAHWPRYPHLWVRLYVLELYCIILGLPPCLNILRRKQ
PQLTFFTIALQSCHYQRLPPHILWATGLKSGSETPGTSESATPESDKKYS
IGLAIGTNSVGWAVITDEYKVPSKKFKVLGNTDRHSIKKNLIGALLFDSG
ETAEATRLKRTARRRYTRRKNRICYLQEIFSNEMAKVDDSFFHRLEESFL
VEEDKKHERHPIFGNIVDEVAYHEKYPTIYHLRKKLVDSTDKADLRLIYL
ALAHMIKFRGHFLIEGDLNPDNSDVDKLFIQLVQTYNQLFEENPINASGV
DAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSK
NGYAGYIDGGASQEEFYKFIKPILEKMDGTEELLVKLNREDLLRKQRTFD
NGSIPHQIHLGELHAILRRQEDFYPFLKDNREKIEKILTFRIPYYVGPLA
RGNSRFAWMTRKSEETITPWNFEEVVDKGASAQSFIERMTNFDKNLPNEK
VLPKHSLLYEYFTVYNELTKVKYVTEGMRKPAFLSGEQKKAIVDLLFKTN
RKVTVKQLKEDYFKKIECFDSVEISGVEDRFNASLGTYHDLLKIIKDKDF
LDNEENEDILEDIVLTLTLFEDREMIEERLKTYAHLFDDKVMKQLKRRRY
TGWGRLSRKLINGIRDKQSGKTILDFLKSDGFANRNFMQLIHDDSLTFKE
DIQKAQVSGQGDSLHEHIANLAGSPAIKKGILQTVKVVDELVKVMGRHKP
ENIVIEMARENQTTQKGQKNSRERMKRIEEGIKELGSQILKEHPVENTQL
QNEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVI
TLKSKLVSDFRKDFQFYKVREINNYHHAHDAYLNAVVGTALIKKYPKLES
EFVYGDYKVYDVRKMIAKSEQEIGKATAKYFFYSNIMNFFKTEITLANGE
IRKRPLIETNGETGEIVWDKGRDFATVRKVLSMPQVNIVKKTEVQTGGFS
KESILPKRNSDKLQNEKLYLYYLQNGRDMYVDQELDINRLSDYDVDHIVP
QSFLKDDSIDNKVLTRSDKNRGKSDNVPSEEVVKKMKNYWRQLLNAKLIT
QRKFDNLTKAERGGLSELDKAGFIKRQLVETRQITKHVAQILDSRMNTKY
DENDKLIREVKVITLKSKLVSDFRKDFQFYKVREINNYHHAHDAYLNAVV
GTALIKKYPKLESEFVYGDYKVYDVRKMIAKSEQEIGKATAKYFFYSNIM
NFFKTEITLANGEIRKRPLIETNGETGEIVWDKGRDFATVRKVLSMPQVN
IVKKTEVQTGGFSKESILPKRNSDKLIARKKDWDPKKYGGFDSPTVAYSV
LVVAKVEKGKSKKLKSVKELLGITIMERSSFEKNPIDFLEAKGYKEVKKD
LIIKLPKYSLFELENGRKRMLASAGELQKGNELALPSKYVNFLYLASHYE

-continued

KLKGSPEDNEQKQLFVEQHKHYLDEIIEQISEFSKRVILADANLDKVLSA
YNKHRDKPIREQAENIIHLFTLTNLGAPAAFKYFDTTIDRKRYTSTKEVL
DATLIHQSITGLYETRIDLSQLGGD*SGGS*

(SEQ ID NO: 120)

[UGI]*SGGSGGSGGS*

(SEQ ID NO: 41)

[Polymerase]PKKKRKV

N-terminal UDG (insert UDG (Tyr147A1a) or UDG (Asn204Asp))+Cas9 nickase and Polymerase at C-terminus—In the below construct, the NLS sequence is identified by underlining and linkers are identified in italics. The "[UDGvariants]" indicated in the sequence below identifies the location where UDG Tyr147Ala and UDG Asn204Asp, were inserted. The "[Polymerase]" indicated in the sequence below identifies the location where polymerases (e.g., Pol Beta, Pol Lambda, Pol Eta, Pol Mu, Pol Iota, Pol Kappa, Pol Alpha, Pol Delta, Pol Gamma, and Pol Nu), and Rev1 were inserted.

(SEQ ID NO: 118)

[UDGvariants]SETPGTSESATPESDKKYSIGLAIGTNSVGWAVITD
EYKVPSKKFKVLGNTDRHSIKKNLIGALLFDSGETAEATRLKRTARRRY
TRRKNRICYLQEIFSNEMAKVDDSFFHRLEESFLVEEDKKHERHPIFGN
IVDEVAYHEKYPTIYHLRKKLVDSTDKADLRLIYLALAHMIKFRGHFLI
EGDLNPDNSDVDKLFIQLVQTYNQLFEENPINASGVDAKAILSARLSKS
RRLENLIAQLPGEKKNGLFGNLIALSLGLTPNFKSNFDLAEDAKLQLSK
DTYDDDLDNLLAQIGDQYADLFLAAKNLSDAILLSDILRVNTEITKAPL
SASMIKRYDEHHQDLTLLKALVRQQLPEKYKEIFFDQSKNGYAGYIDGG
ASQEEFYKFIKPILEKMDGTEELLVKLNREDLLRKQRTFDNGSIPHQIH
LGELHAILRRQEDFYPFLKDNREKIEKILTFRIPYYVGPLARGNSRFAW
MTRKSEETITPWNFEEVVDKGASAQSFIERMTNFDKNLPNEKVLPKHSL
LYEYFTVYNELTKVKYVTEGMRKPAFLSGEQKKAIVDLLFKTNRKVTVK
QLKEDYFKKIECFDSVEISGVEDRFNASLGTYHDLLKIIKDKDFLDNEE
NEDILEDIVLTLTLFEDREMIEERLKTYAHLFDDKVMKQLKRRRYTGWG
RLSRKLINGIRDKQSGKTILDFLKSDGFANRNFMQLIHDDSLTFKEDIQ
KAQVSGQGDSLHEHIANLAGSPAIKKGILQTVKVVDELVKVMGRHKPEN
IVIEMARENQTTQKGQKNSRERMKRIEEGIKELGSQILKEHPVENTQLQ
NEKLYLYYLQNGRDMYVDQELDINRLSDYDVDHIVPQSFLKDDSIDNKV
LTRSDKNRGKSDNVPSEEVVKKMKNYWRQLLNAKLITQRKFDNLTKAER
GGLSELDKAGFIKRQLVETRQITKHVAQILDSRMNTKYDENDKLIREVK
VITLKSKLVSDFRKDFQFYKVREINNYHHAHDAYLNAVVGTALIKKYPK
LESEFVYGDYKVYDVRKMIAKSEQEIGKATAKYFFYSNIMNFFKTEITL
ANGEIRKRPLIETNGETGEIVWDKGRDFATVRKVLSMPQVNIVKKTEVQ
TGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLP
KYSLFELENGRKRMLASAGELQKGNELALPSKYVNFLYLASHYEKLKGS -continued

PEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDAT

LIHQSITGLYETRIDLSQLGGD*SGGS*

(SEQ ID NO: 41)

[Polymerase]PKKKRKV

Example 1: C to G Approach 1—Increase Abasic Site Formation

Figure 3:
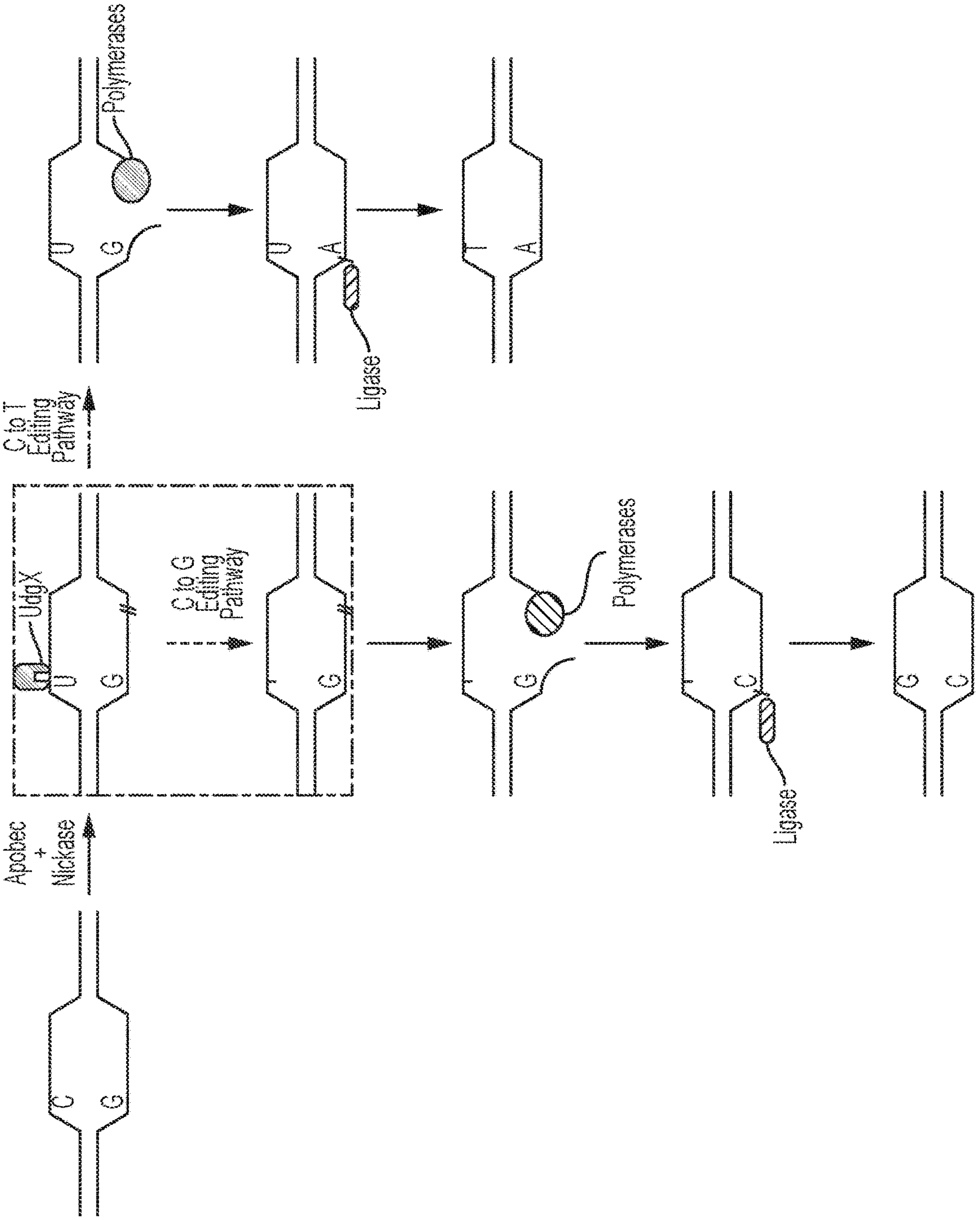
FIG. 3 shows a schematic illustrating scheme 1 from FIG. 1, where an abasic site is formed, for C to G base editing. If the abasic is generated efficiently, this can increase the total flux through C to G editing pathway.
Figure 4:
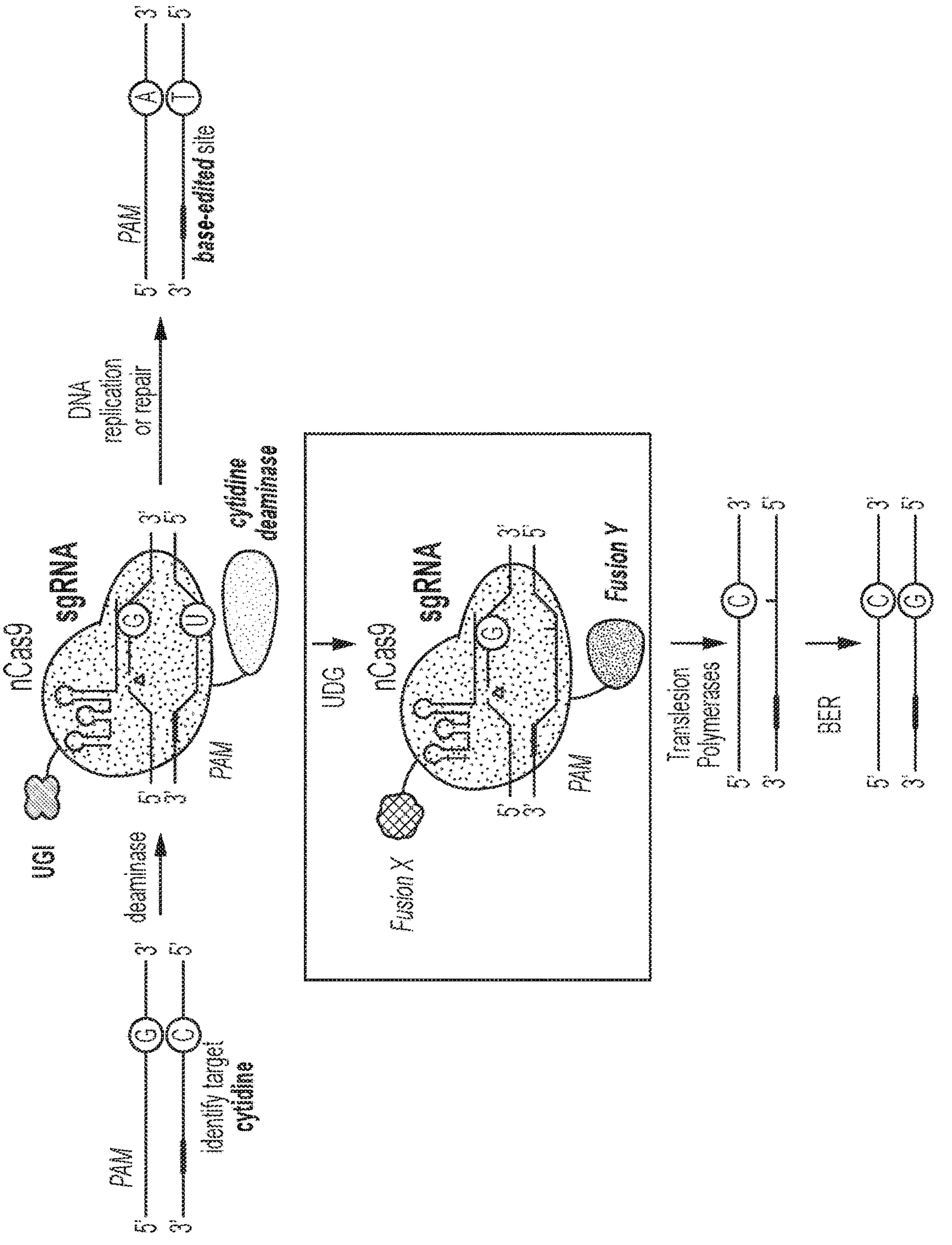
FIG. 4 shows a schematic illustrating approach 1 for C to G base editing where an increase in abasic site formation is used. If the abasic is generated efficiently, for example by using a UDG domain and a translesion polymerase, this can increase the total flux through C to G editing pathway.
Figure 5:
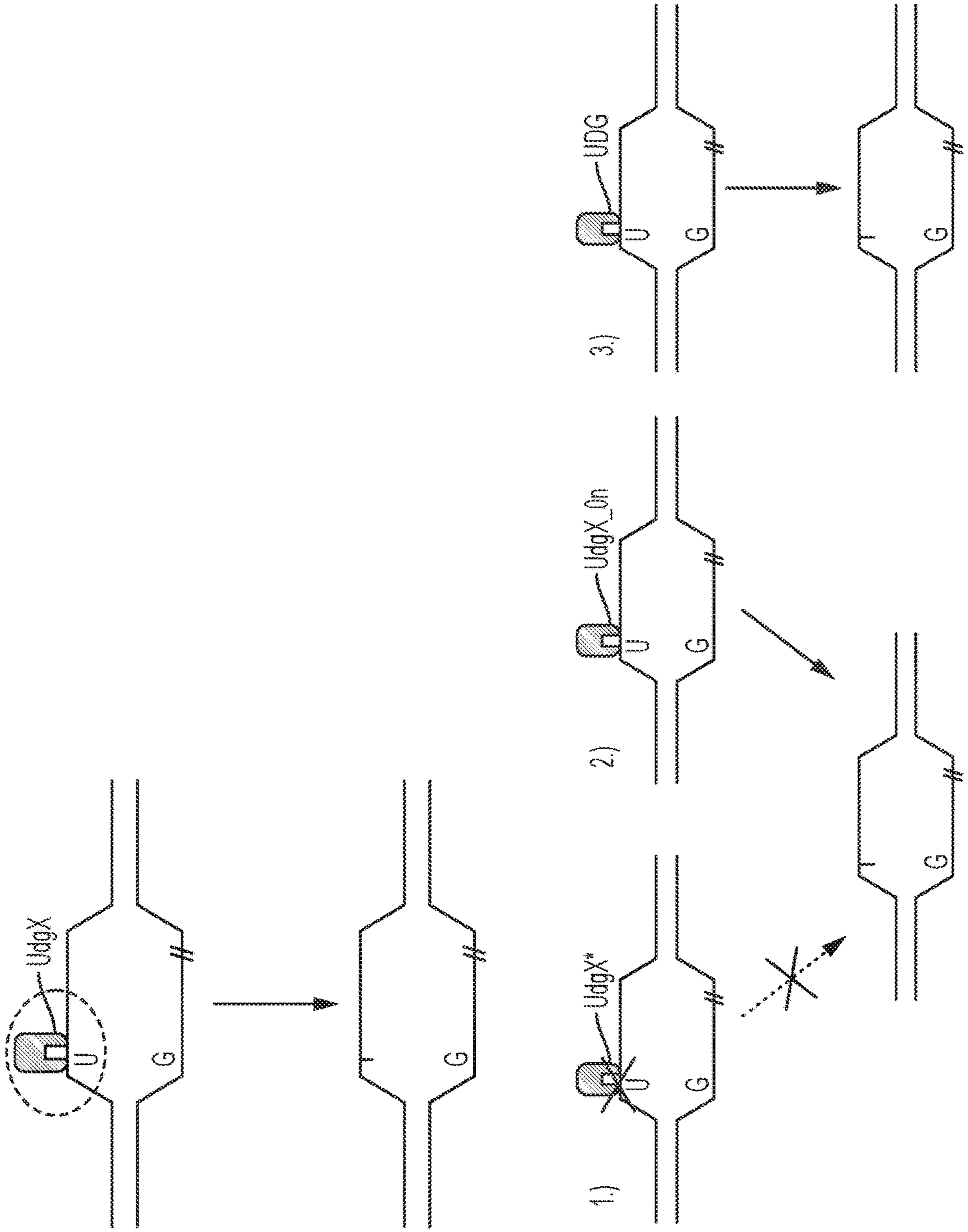
FIG. 5 shows a schematic illustrating the effect of UdgX on base editing. UdgX, an orthologue of UDG identified to bind tightly to Uracil with minimal uracil excising activity, increases the amount of C to G editing. In 1.) UdgX* is a variant of UDG which was determined to lack uracil binding activity via an in vitro assay. In 2.) UdgX_On is a variant which was shown to increase uracil excision through an in vitro assay. In 3.) UDG direct fusion excises uracil.
Figure 6:
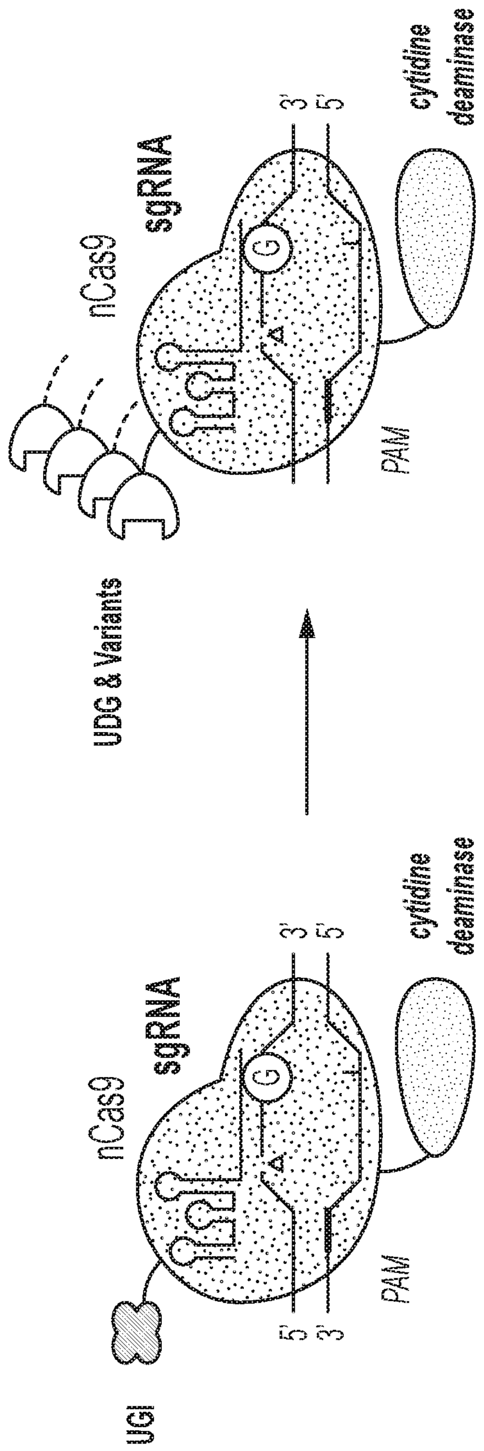
FIG. 6 shows a schematic (on the left) illustrating an exemplary C to T base editor (e.g., BE3), which contains a uracil glycosylase inhibitor (UGI), a Cas9 domain (e.g., nCas9), and a cytidine deaminase. On the right is a schematic illustrating a C to G base editor, which contains a uracil DNA glycosylase (UDG) (or variants thereof), a Cas9 domain (e.g., nCas9), and a cytidine deaminase.
Figure 7:
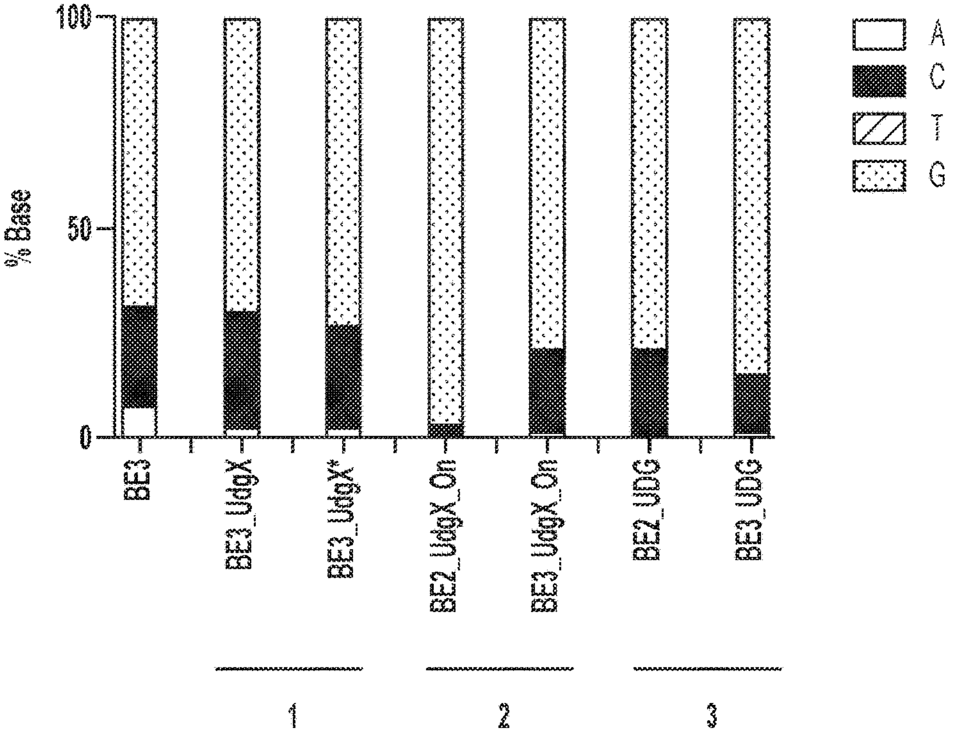
FIG. 7 shows total editing percentages at the HEK2 site in WT Hap1 cells using seven base editors (BE3; BE3_UdgX; BE3_UdgX*; BE2_UdgX_On; BE3_UdgX_On; BE2_UDG; and BE3_UDG). Raw editing values are shown in the left panel. The panel on the right shows a graphical representation of the raw editing values, where C to G base editing is graphically shown by dotted bars (G) going to filled bars (C), as sequencing was performed on the DNA strand opposite of the strand containing the edited C.
Figure 8:
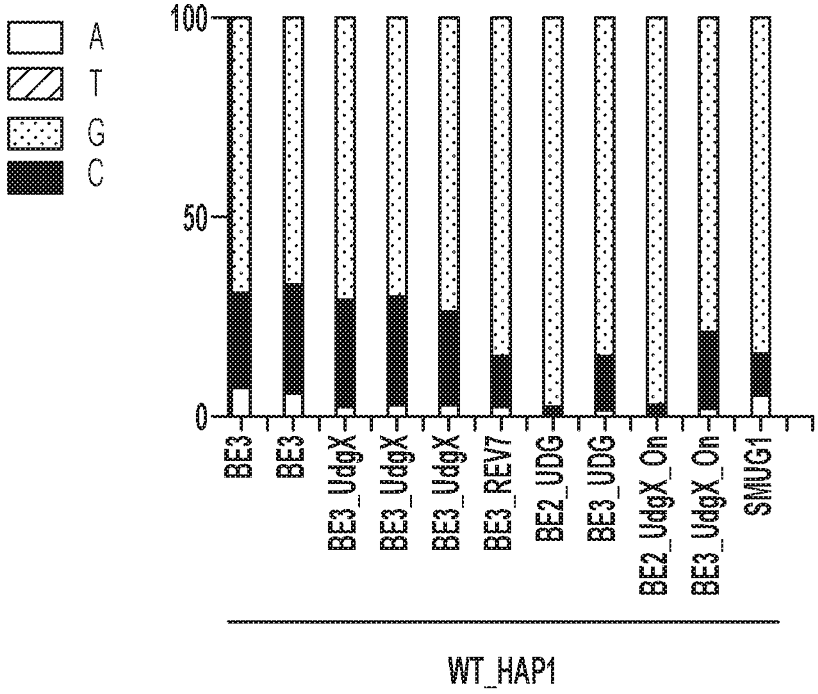
FIG. 8 shows total editing percentages at the HEK2 site with additional C to G base editors (BE3; BE3_UdgX; BE3_REV7; and SMUG1, where BE3 and BE3_UdgX are repeated from FIG. 4) in WT Hap1 cells. The top panel shows the raw editing values. The bottom panel shows a graphical representation of the raw editing values, where C to G base editing is graphically shown by dotted bars (G) going to filled bars (C), as sequencing was performed on the DNA strand opposite of the strand containing the edited C.
Figure 9:
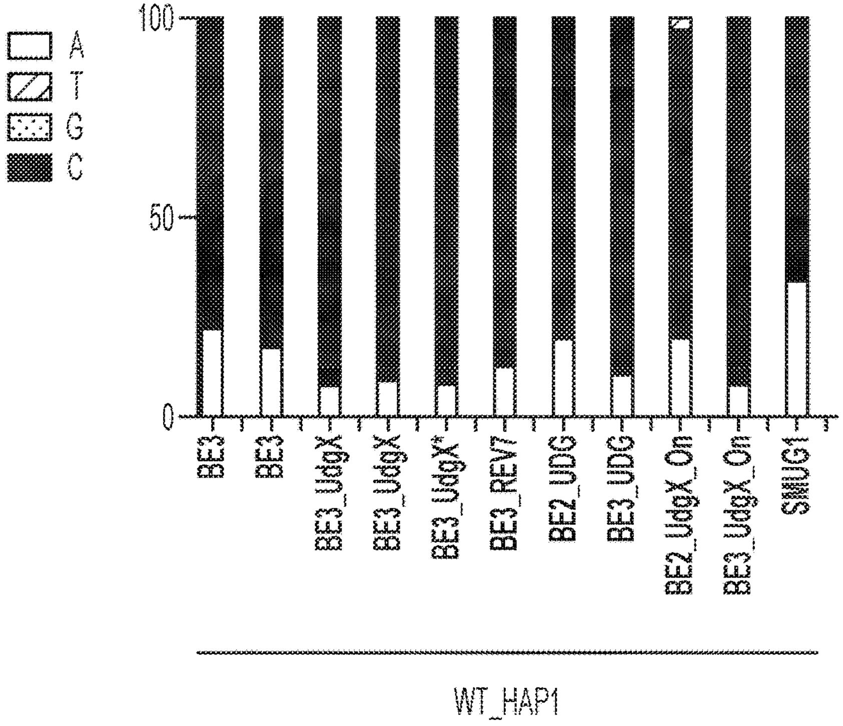
FIG. 9 shows the editing specificity ratio at the HEK2 site with various C to G base editors (BE3; BE3_UdgX; BE3_UdgX*; BE3_REV7; BE2_UDG; BE3_UDG BE2_UdgX_On; BE3_UdgX_On; and SMUG1) in WT Hap1 cells. The top pane shows the total percentage of edits and the ratio of edits that have been made from G to A, C, or T. The bottom panel is a graphical representation of the specificity ratio values.
Figure 10:
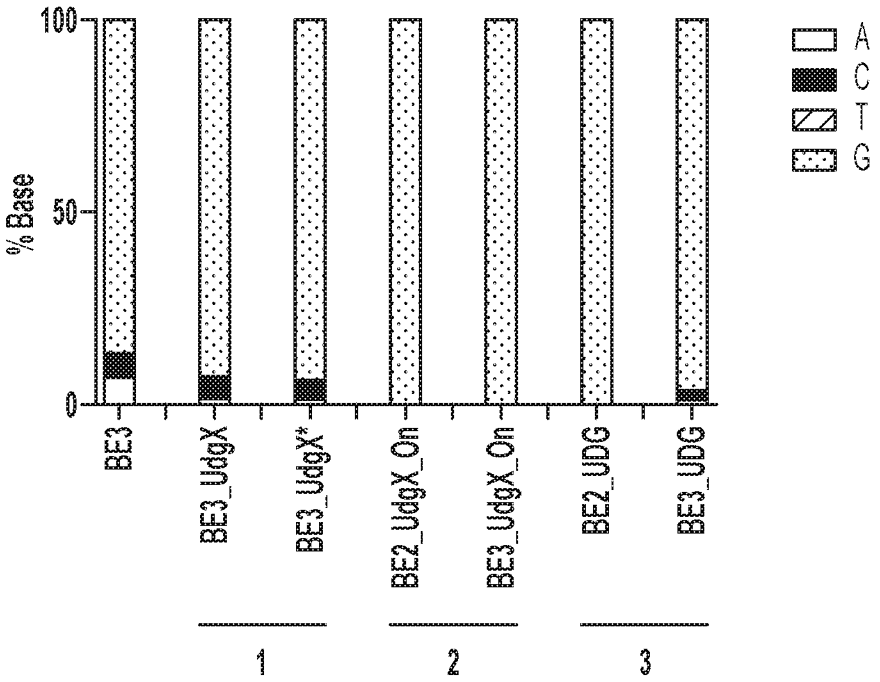
FIG. 10 shows total editing percentages at the RNF2 site in WT Hap1 cells using seven base editors (BE3; BE3_UdgX; BE3_UdgX*; BE2_UdgX_On; BE3_UdgX_On; BE2_UDG; and BE3_UDG). Raw editing values are shown in the left panel. The panel on the right shows a graphical representation of the raw editing values, where C to G base editing is graphically shown by dotted bars (G) going to filled bars (C), as sequencing was performed on the DNA strand opposite of the strand containing the edited C.
Figure 11:
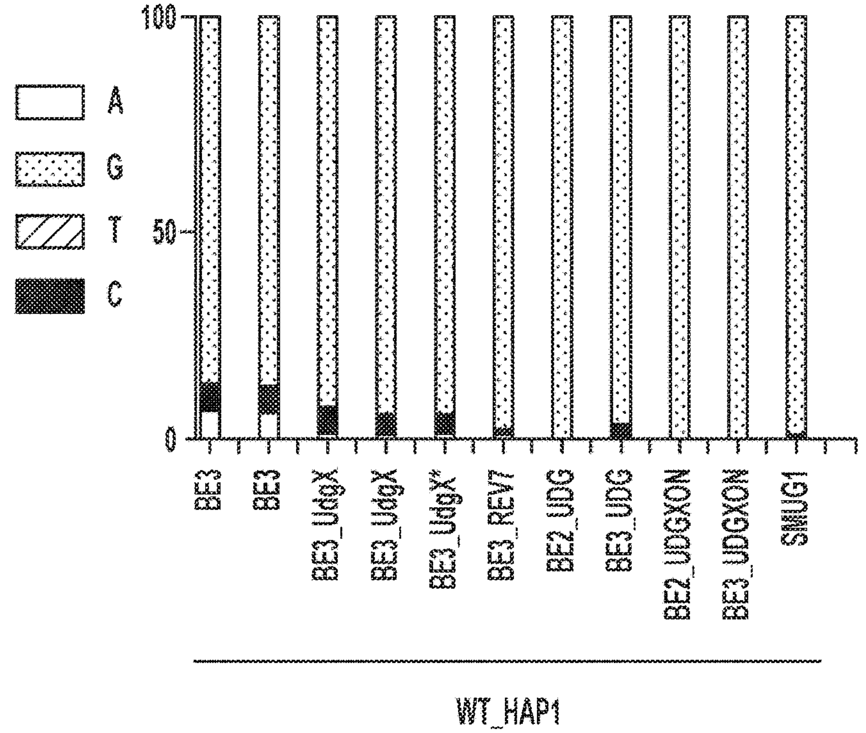
FIG. 11 shows total editing percentages at the RNF2 site with additional C to G base editors (BE3; BE3_UdgX; BE3_REV7; and SMUG1, where BE3 and BE3_UdgX are repeated from FIG. 7) in WT Hap1 cells. The top panel shows the raw editing values. The bottom panel shows a graphical representation of the raw editing values, where C to G base editing is graphically shown by dotted bars (G) going to filled bars (C), as sequencing was performed on the DNA strand opposite of the strand containing the edited C.
Figure 12:
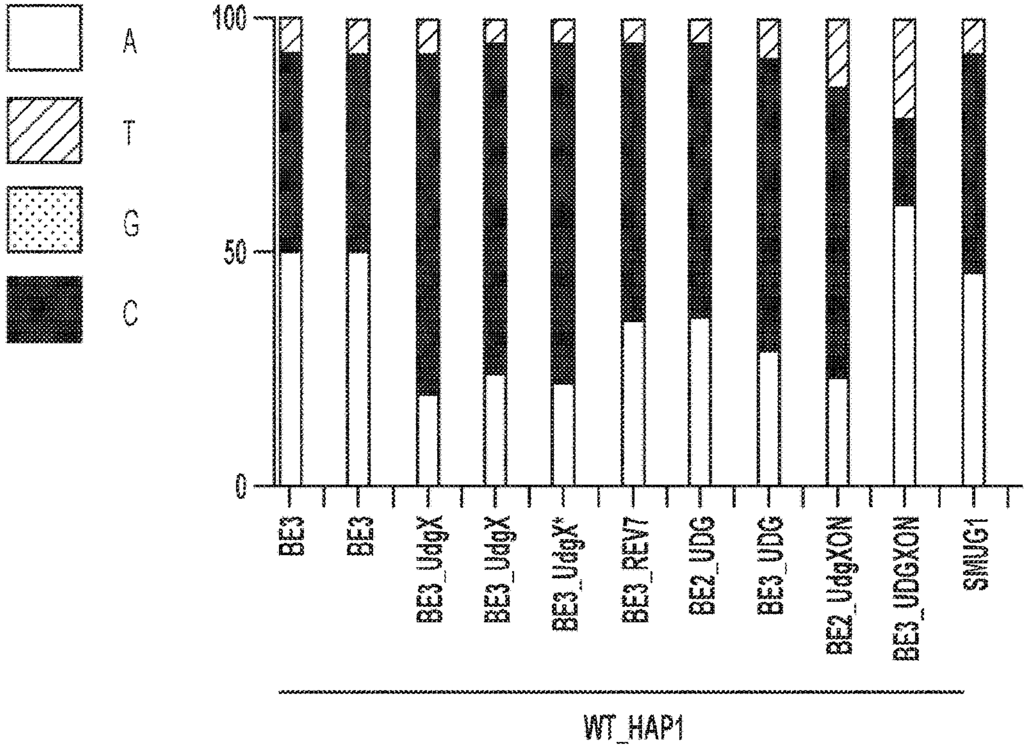
FIG. 12 shows editing specificity ratio at the RNF2 site with various C to G base editors (BE3; BE3_UdgX; BE3_UdgX*; BE3_REV7; BE2_UDG; BE3_UDG BE2_UdgX_On; BE3_UdgX_On; and SMUG1) in WT Hap1 cells. The top pane shows the total percentage of edits and the ratio of edits that have been made from G to A, C, or T. The bottom panel is a graphical representation of the specificity ratio values.
Figure 13:
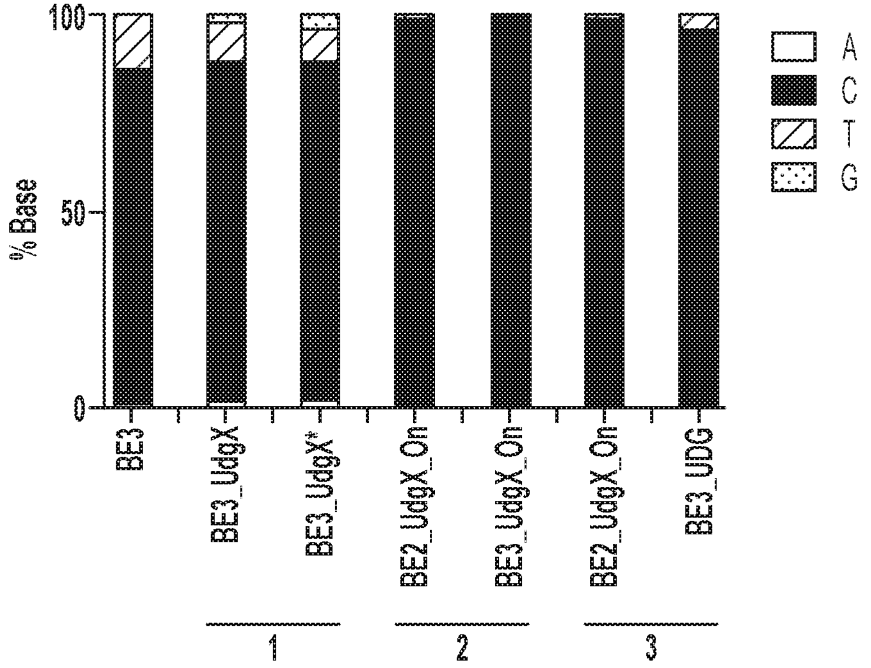
FIG. 13 shows total editing percentages at the FANCF site in WT Hap1 cells using seven base editors (BE3; BE3_UdgX; BE3_UdgX*; BE2_UdgX_On; BE3_UdgX_On; BE2_UDG; and BE3_UDG). Raw editing values are shown in the left panel. The panel on the right shows a graphical representation of the raw editing values, where C to G base editing is graphically shown by filled bars (C) going to dotted bars (G).
Figure 14:
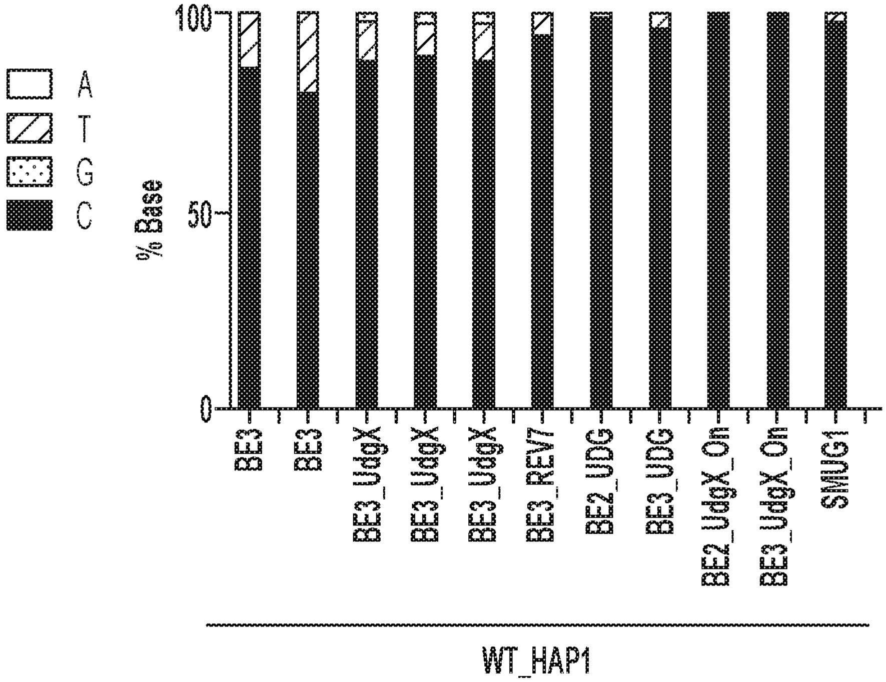
FIG. 14 shows total editing percentages at the FANCF site with additional C to G base editors (BE3; BE3_UdgX; BE3_REV7; and SMUG1, where BE3 and BE3_UdgX are repeated from FIG. 10) in WT Hap1 cells. The top panel shows the raw editing values. The bottom panel shows a graphical representation of the raw editing values, where C to G base editing is graphically shown by filled bars (C) going to dotted bars (G).
Figure 15:
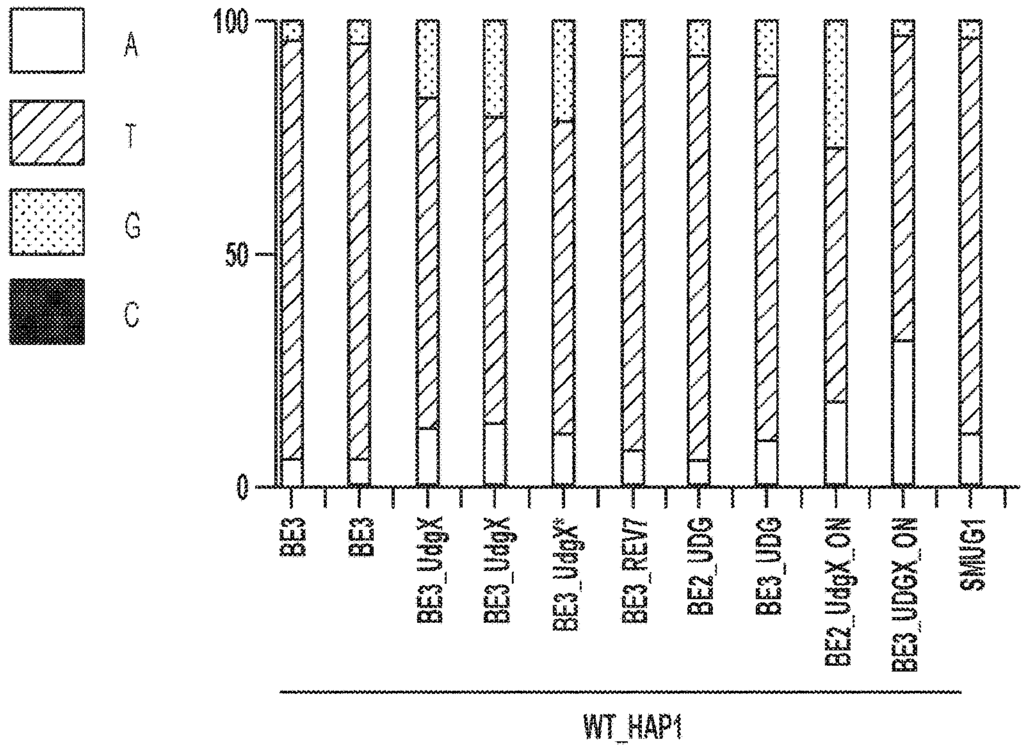
FIG. 15 shows the editing specificity ratio at the FANCF site with various C to G base editors (BE3; BE3_UdgX; BE3_UdgX*; BE3_REV7; BE2_UDG; BE3_UDG BE2_UdgX_On; BE3_UdgX_On; and SMUG1) in WT Hap1 cells. The top pane shows the total percentage of edits and the ratio of edits that have been made from C to A, G, or T. The bottom panel is a graphical representation of the specificity ratio values.
Figure 16:
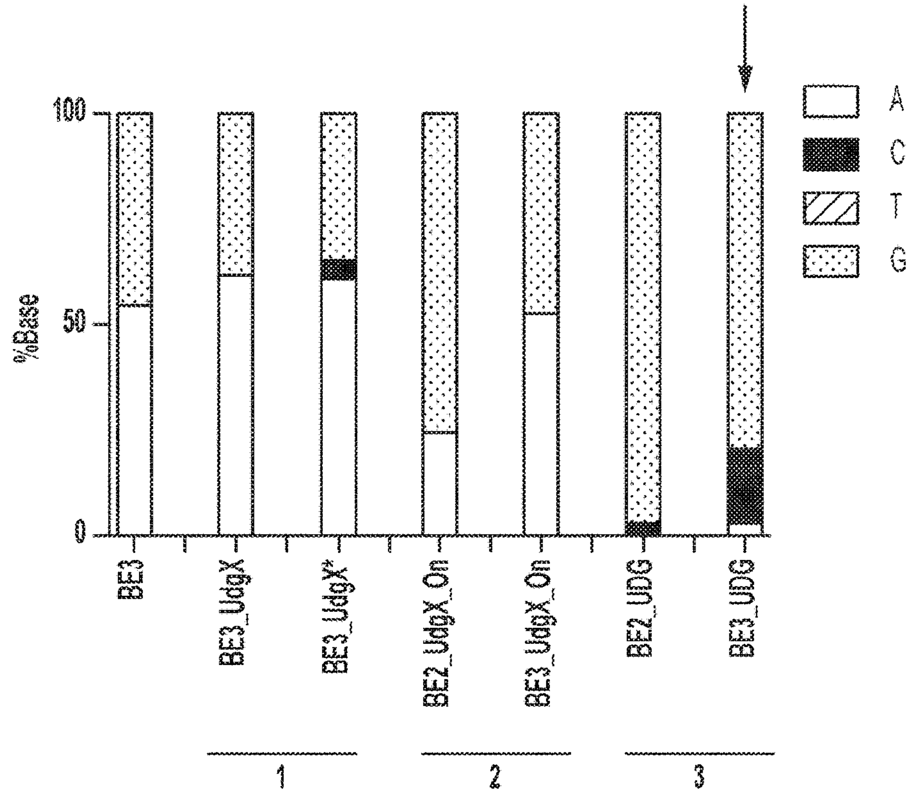
FIG. 16 shows total editing percentages at the HEK2 site in $UDG^{-/-}$ Hap1 cells using seven base editors (BE3; BE3_UdgX; BE3_UdgX*; BE2_UdgX_On; BE3_UdgX_On; BE2_UDG; and BE3_UDG). Raw editing values are shown in the left panel. The panel on the right shows a graphical representation of the raw editing values, where C to G base editing is graphically shown by dotted bars (G) going to filled bars (C), as sequencing was performed on the DNA strand opposite of the strand containing the edited C.
Figure 17:
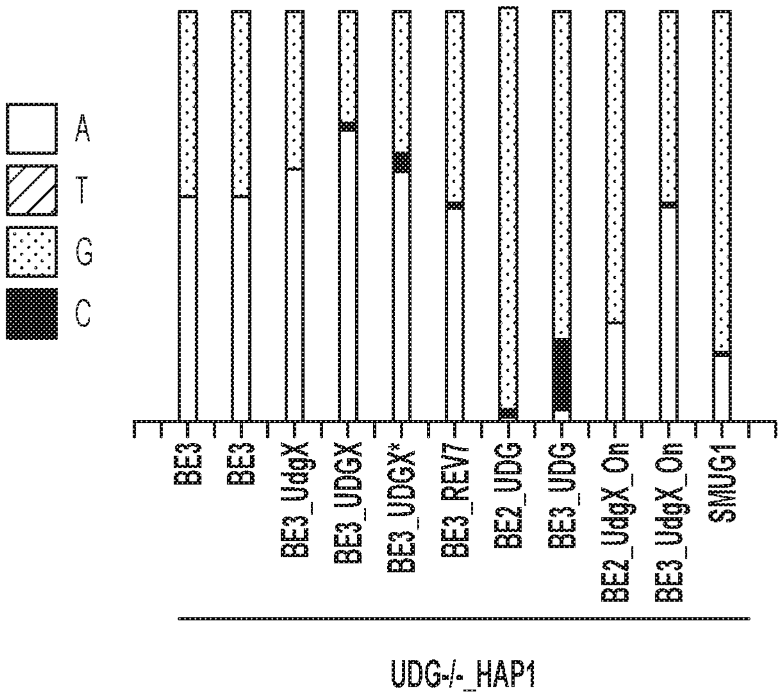
FIG. 17 shows total editing percentages at the HEK2 site with additional C to G base editors (BE3; BE3_UdgX; BE3_REV7; and SMUG1, where BE3 and BE3_UdgX are repeated from FIG. 13) in $UDG^{-/-}$ Hap1 cells. The top panel shows the raw editing values. The bottom panel shows a graphical representation of the raw editing values, where C to G base editing is graphically shown by dotted bars (G) going to filled bars (C), as sequencing was performed on the DNA strand opposite of the strand containing the edited C.
Figure 18:
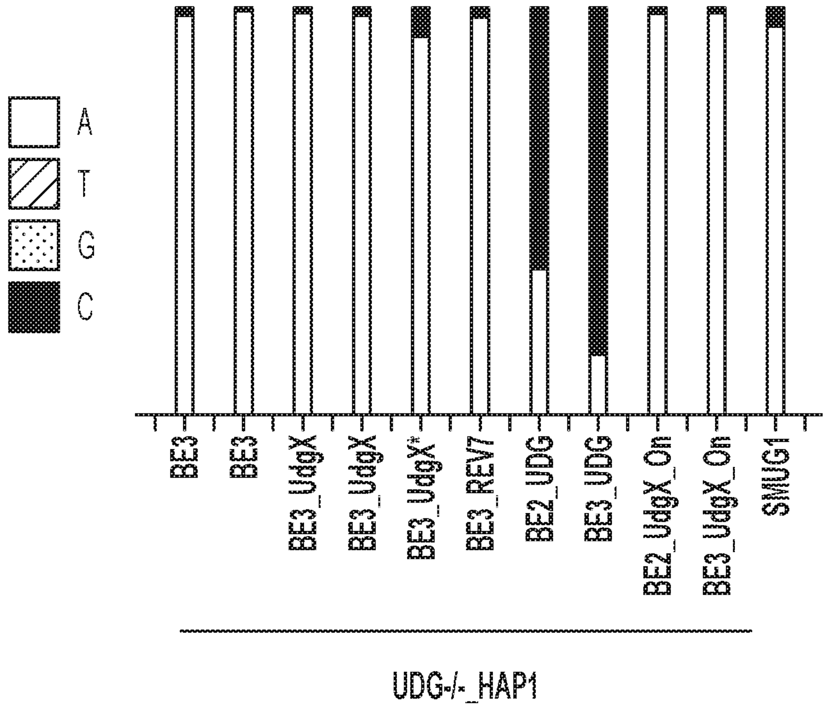
FIG. 18 shows editing specificity ratio at the HEK2 site with various C to G base editors (BE3; BE3_UdgX; BE3_UdgX*; BE3_REV7; BE2_UDG; BE3_UDG BE2_UdgX_On; BE3_UdgX_On; and SMUG1) in $UDG^{-/-}$ Hap1 cells. The top pane shows the total percentage of edits and the ratio of edits that have been made from G to A, C, or T. The bottom panel is a graphical representation of the specificity ratio values.
Figure 19:
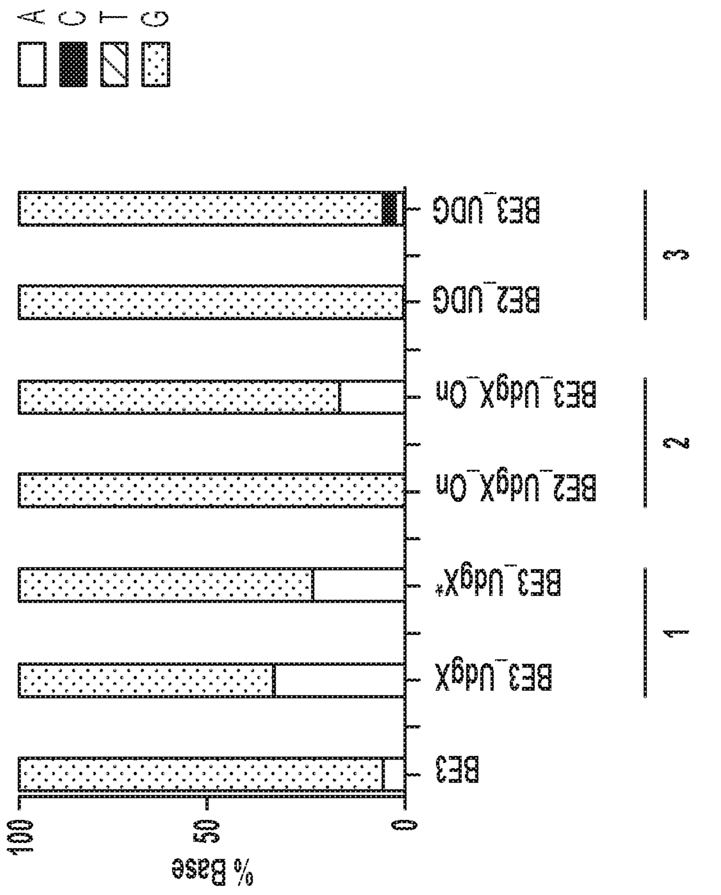
FIG. 19 shows total editing percentages at the RNF2 site in $UDG^{-/-}$ Hap1 cells using seven base editors (BE3; BE3_UdgX; BE3_UdgX*; BE2_UdgX_On; BE3_UdgX_On; BE2_UDG; and BE3_UDG). Raw editing values are shown in the left panel. The panel on the right shows a graphical representation of the raw editing values, where C to G base editing is graphically shown by dotted bars (G) going to filled bars (C), as sequencing was performed on the DNA strand opposite of the strand containing the edited C.
Figure 20:
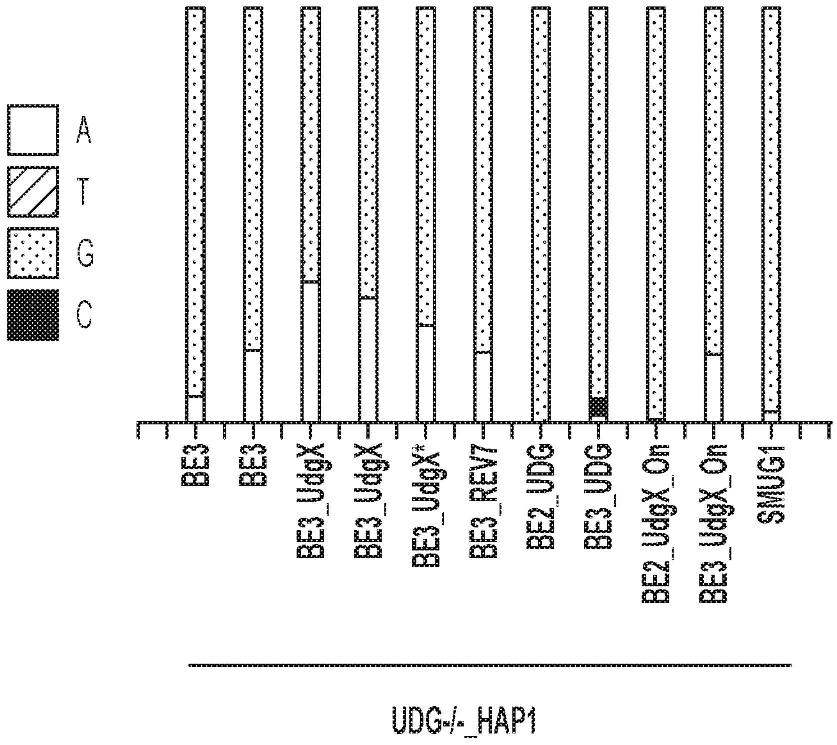
FIG. 20 shows total editing percentages at the RNF2 site with additional C to G base editors (BE3; BE3_UdgX; BE3_REV7; and SMUG1, where BE3 and BE3_UdgX are repeated from FIG. 16) in $UDG^{-/-}$ Hap1 cells. The top panel shows the raw editing values. The bottom panel shows a graphical representation of the raw editing values, where C to G base editing is graphically shown by dotted bars (G) going to filled bars (C), as sequencing was performed on the DNA strand opposite of the strand containing the edited C.
Figure 21:
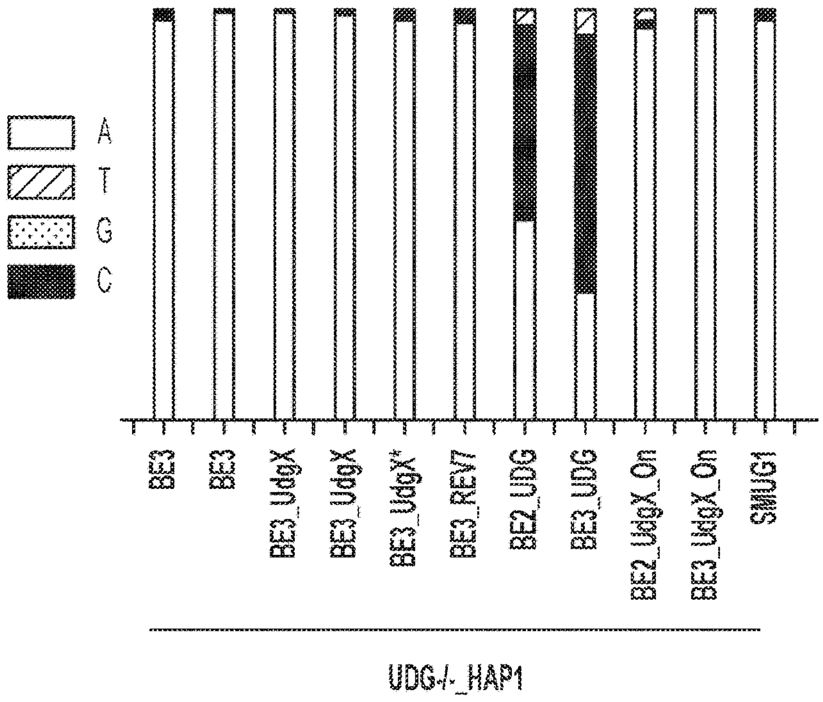
FIG. 21 shows the editing specificity ratio at the RNF2 site with various C to G base editors (BE3; BE3_UdgX; BE3_UdgX*; BE3_REV7; BE2_UDG; BE3_UDG BE2_UdgX_On; BE3_UdgX_On; and SMUG1) in $UDG^{-/-}$ Hap1 cells. The top pane shows the total percentage of edits and the ratio of edits that have been made from G to A, C, or T. The bottom panel is a graphical representation of the specificity ratio values.
Figure 22:
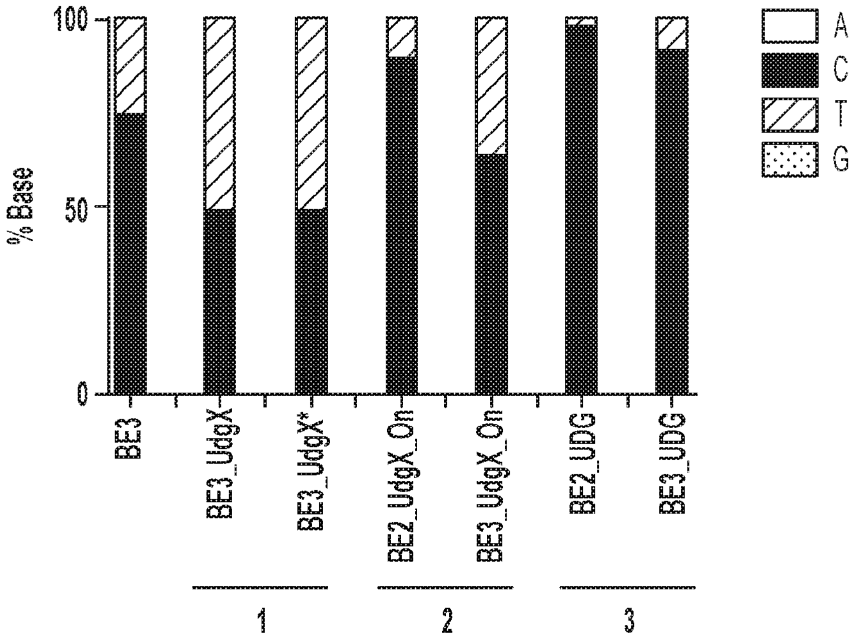
FIG. 22 shows total editing percentages at the FANCF site in $UDG^{-/-}$ Hap1 cells using seven base editors (BE3; BE3_UdgX; BE3_UdgX*; BE2_UdgX_On; BE3_UdgX_On; BE2_UDG; and BE3_UDG). Raw editing values are shown in the left panel. The panel on the right shows a graphical representation of the raw editing values, where C to G base editing is graphically shown by filled bars (C) going to dotted bars (G).
Figure 23:
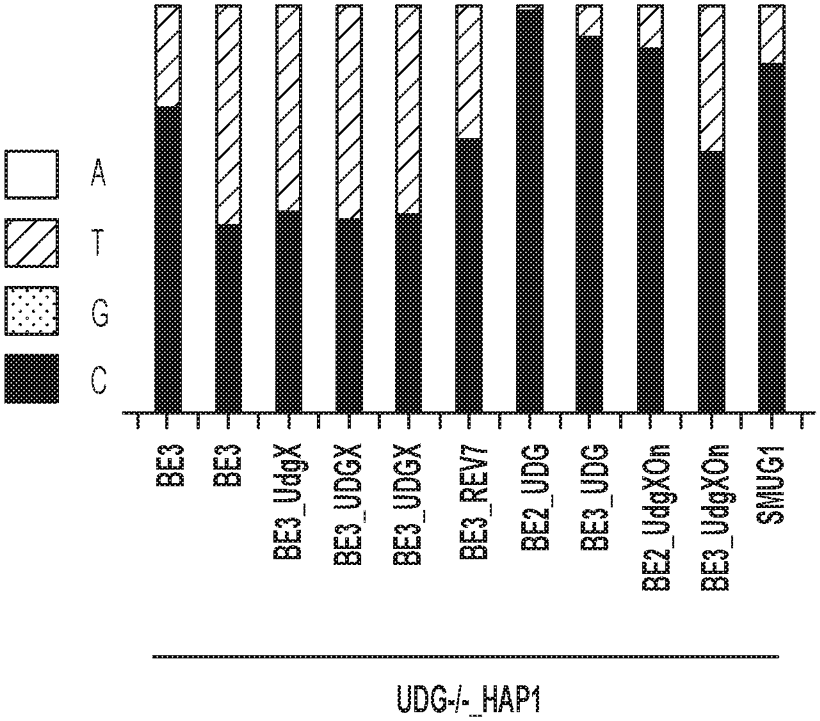
FIG. 23 shows total editing percentages at the FANCF site with additional C to G base editors (BE3; BE3_UdgX; BE3_REV7; and SMUG1, where BE3 and BE3_UdgX are repeated from FIG. 19) in $UDG^{-/-}$ Hap1 cells. The top panel shows the raw editing values. The bottom panel shows a graphical representation of the raw editing values, where C to G base editing is graphically shown by filled bars (C) going to dotted bars (G).
Figure 24:
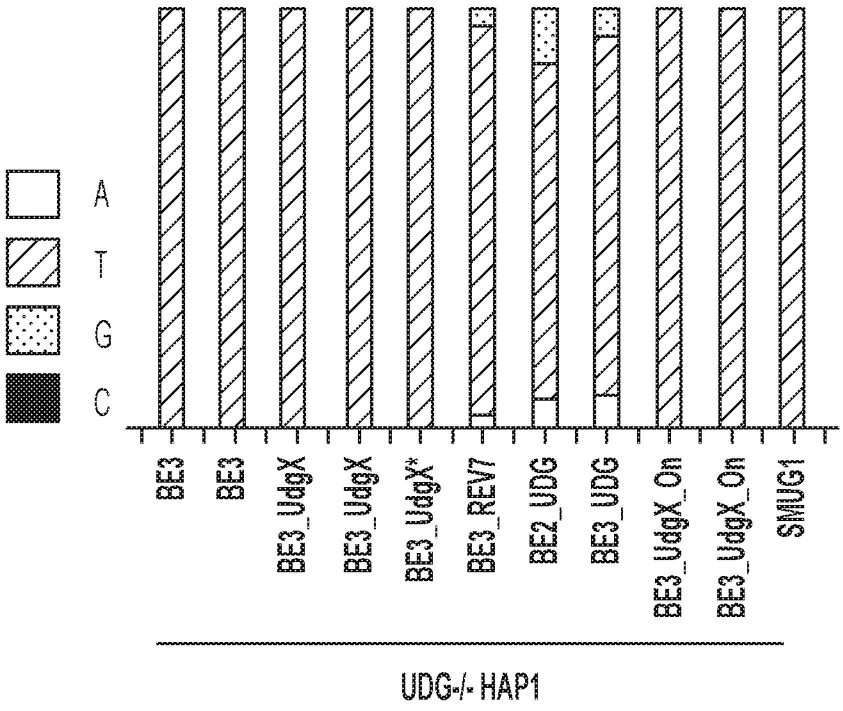
FIG. 24 shows the editing specificity ratio at the FANCF site with various C to G base editors (BE3; BE3_UdgX; BE3_UdgX*; BE3_REV7; BE2_UDG; BE3_UDG BE2_UdgX_On; BE3_UdgX_On; and SMUG1) in $UDG^{-/-}$ Hap1 cells. The top pane shows the total percentage of edits and the ratio of edits that have been made from C to A, G, or T. The bottom panel is a graphical representation of the specificity ratio values.
Figure 25:
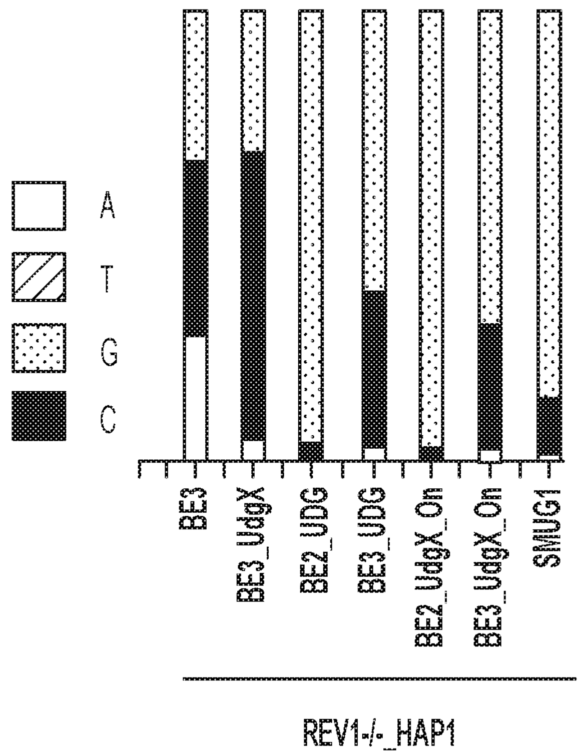
FIG. 25 shows total editing percentages at the HEK2 site with various C to G base editors (BE3; BE3_UdgX; BE2_UNG; BE3_UNG; BE2UdgX_On; BE3UdgX_On; and SMUG1) in $REV1^{-/-}$ Hap1 cells. The top panel shows the raw editing values. The bottom panel shows a graphical representation of the raw editing values, where C to G base editing is graphically shown by dotted bars (G) going to filled bars (C), as sequencing was performed on the DNA strand opposite of the strand containing the edited C.
Figure 26:
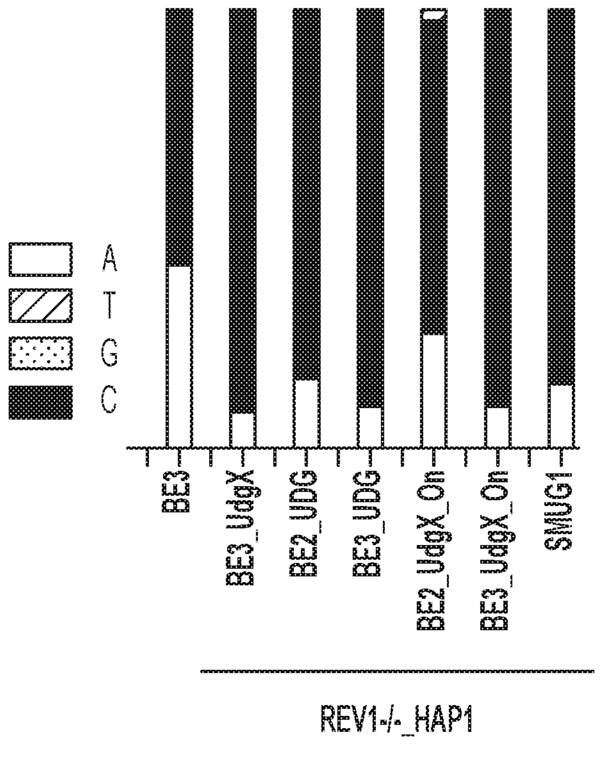
FIG. 26 shows editing specificity ratio at the HEK2 site with various C to G base editors (BE3; BE3_UdgX; BE2_UNG; BE3_UNG; BE2UdgX_On; BE3UdgX_On; and SMUG1) in $REV1^{-/-}$ Hap1 cells. The top pane shows the total percentage of edits and the ratio of edits that have been made from G to A, C, or T. The bottom panel is a graphical representation of the specificity ratio values.
Figure 27:
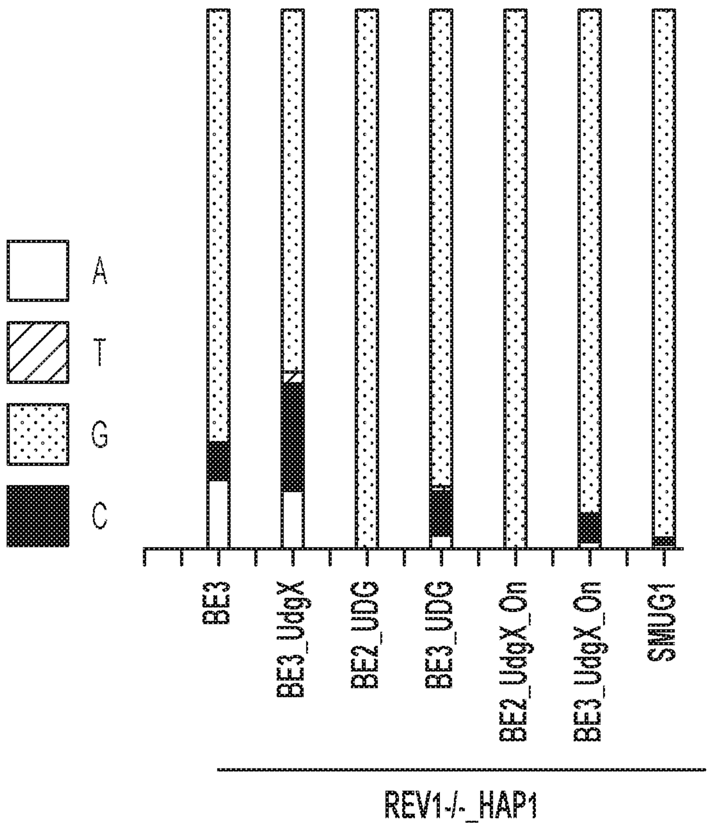
FIG. 27 shows total editing percentages at the RNF2 site with various C to G base editors (BE3; BE3_UdgX; BE2_UNG; BE3_UNG; BE2UdgX_On; BE3UdgX_On; and SMUG1) in $REV1^{-/-}$ Hap1 cells. The top panel shows the raw editing values. The bottom panel shows a graphical representation of the raw editing values, where C to G base editing is graphically shown by dotted bars (G) going to filled bars (C), as sequencing was performed on the DNA strand opposite of the strand containing the edited C.
Figure 28:
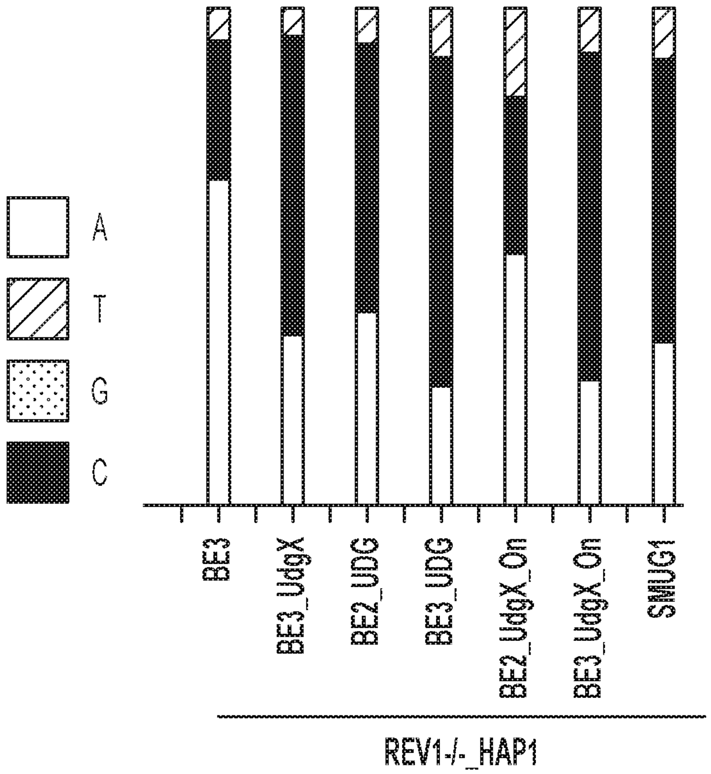
FIG. 28 shows editing specificity ratio at the RNF2 site with various C to G base editors (BE3; BE3_UdgX; BE2_UNG; BE3_UNG; BE2UdgX_On; BE3UdgX_On; and SMUG1) in $REV1^{-/-}$ Hap1 cells. The top pane shows the total percentage of edits and the ratio of edits that have been made from G to A, C, or T. The bottom panel is a graphical representation of the specificity ratio values.
Figure 29:
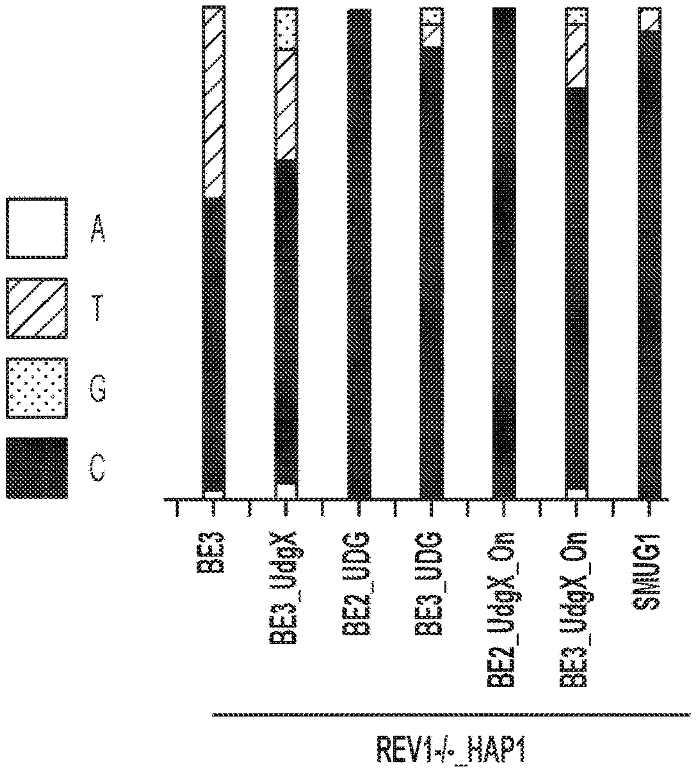
FIG. 29 shows total editing percentages at the FANCF site with various C to G base editors (BE3; BE3_UdgX; BE2_UNG; BE3_UNG; BE2UdgX_On; BE3UdgX_On; and SMUG1) in $REV1^{-/-}$ Hap1 cells. The top panel shows the raw editing values. The bottom panel shows a graphical representation of the raw editing values, where C to G base editing is graphically shown by filled bars (C) going to dotted bars (G).
Figure 30:
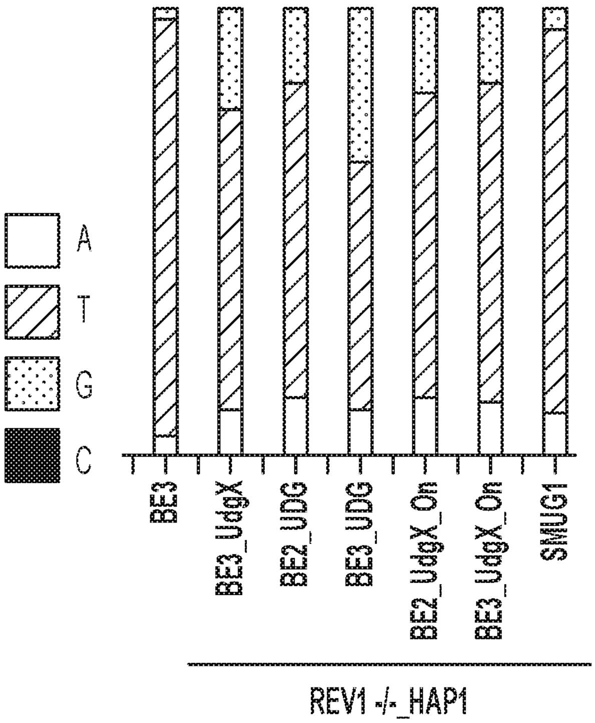
FIG. 30 shows editing specificity ratio at the FANCF site with various C to G base editors (BE3; BE3_UdgX; BE2_UNG; BE3_UNG; BE2UdgX_On; BE3UdgX_On; and SMUG1) in $REV1^{-/-}$ Hap1 cells. The top pane shows the total percentage of edits and the ratio of edits that have been made from C to A, G, or T. The bottom panel is a graphical representation of the specificity ratio values.

If an abasic site is more efficiently generated, it is expected that the total flux through the C to G base editing pathway will be increased. A schematic representation of base editors used in this approach is shown in FIGS. 3 and 4. Using UdgX, an orthologue of UDG identified to bind tightly to Uracil with minimal uracil excising activity, increases the amount of C to G editing. Without wishing to be bound by any particular theory, UdgX near-covalent binding to U mimics a lesion that instigates translesion polymerase-type repair. Further, UdgX has a low level catalytic activity which, in combination with tight binding, excises the U and leads to abasic site formation. Abasic site formation allows for off-target products and preferential generation of this lesion leads to more product. This is supported through different experiments and base editors, which are illustrated in FIGS. 5 and 6.

The results of C to G base editing at HEK2, RNF2, and FANCF sites in WT cells using seven base editors (BE3; BE3_UdgX; BE3_UdgX*; BE2_UdgX_On; BE3_UdgX_On; BE2_UDG; and BE3_UDG) are shown in FIGS. 7 through 15. These figures show the results for C to G editing at the most edited position (C6) at the three representative sites that have high, medium, and low tolerance to sequence perturbation from standard C to T editing.

Results of C to G base editing at HEK2, RNF2, and FANCF sites in UDG−/− cells using various C to G base editors (BE3; BE3_UdgX; BE2_UNG; BE3_UNG; BE2UdgX_On; BE3UdgX_On; and SMUG1) are shown in FIGS. 16 through 24.

Results of C to G base editing at HEK2, RNF2, and FANCF sites in REV1−/− cells using various C to G base editors (BE3; BE3_UdgX; BE2_UNG; BE3_UNG; BE2UdgX_On; BE3UdgX_On; and SMUG1) are shown in FIGS. 25 through 30.

Figure 31:
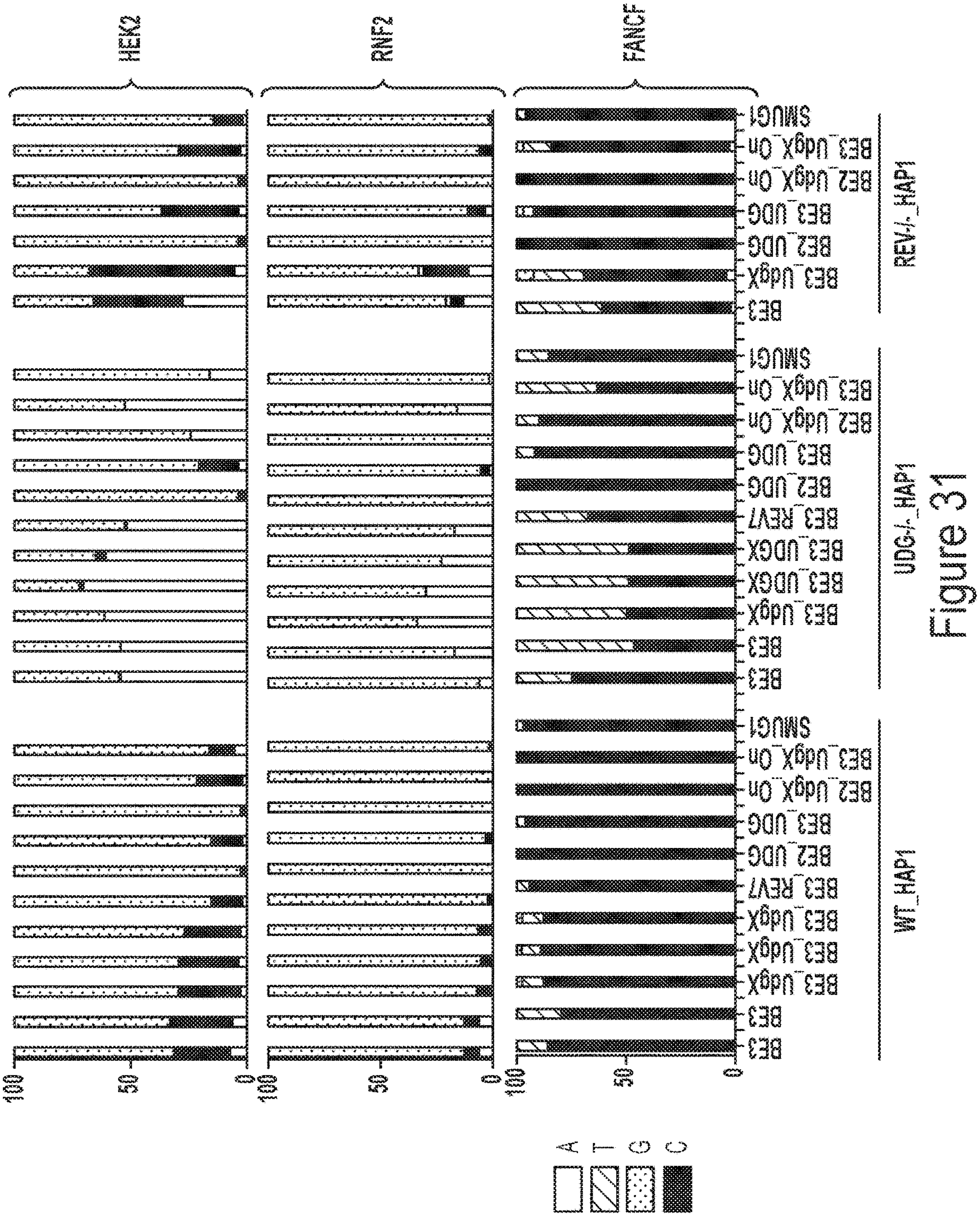
FIG. 31 shows a graphical representation of the raw editing values for the percent of total editing at the HEK2, RNF2, and FANCF sites using the indicated C to G base editors.
Figure 32:
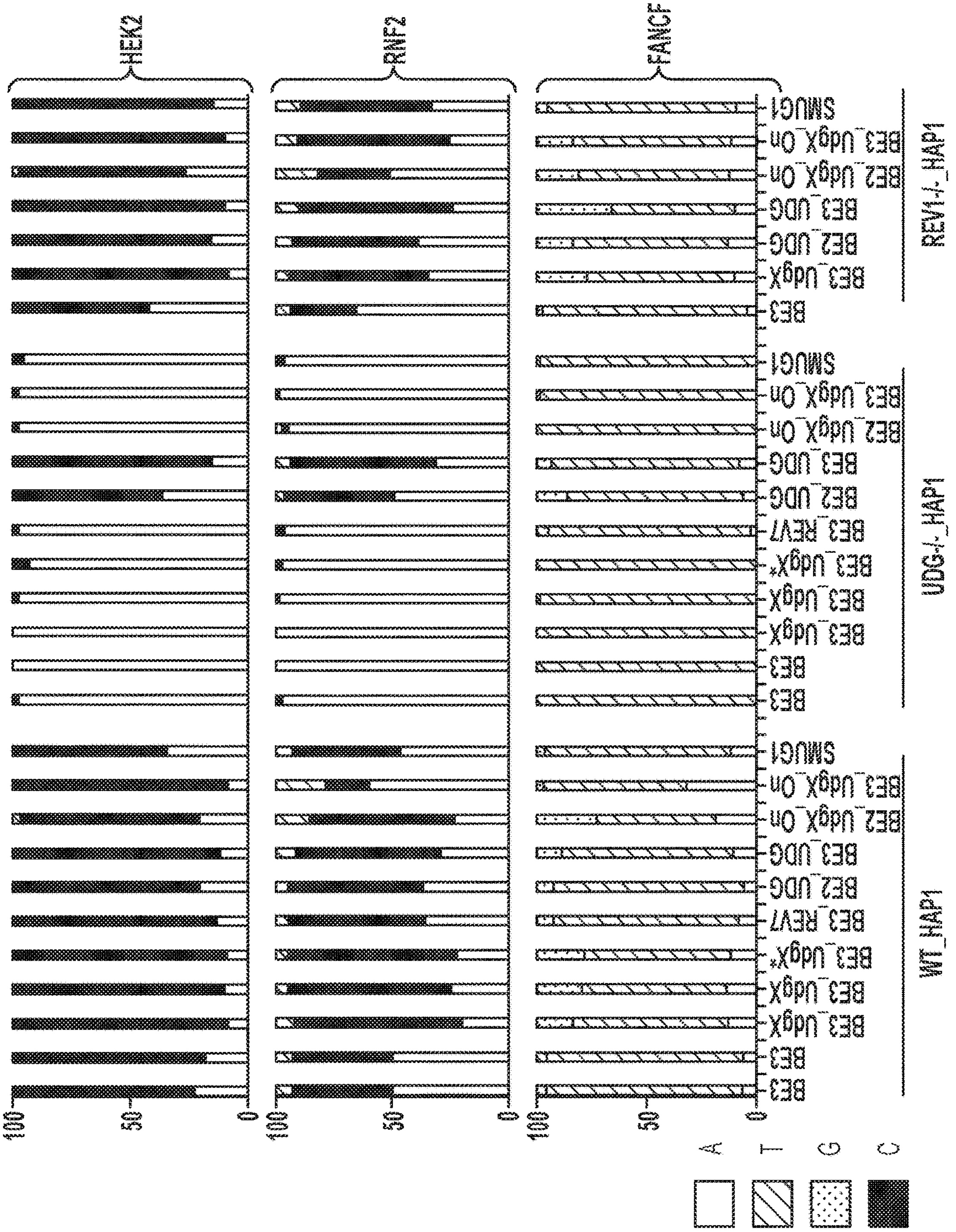
FIG. 32 shows a graphical representation of the specificity ratio for the percent of total editing at the HEK2, RNF2, and FANCF sites.

Results of C to G base editing at HEK2, RNF2, and FANCF sites in the three respective cell types (WT, UDG−/−, and REV1−/− cells) using various C to G base editors (BE3; BE3_UdgX; BE2_UNG; BE3_UNG; BE2UdgX_On; BE3UdgX_On; and SMUG1) are summarized in FIGS. 31 and 32.

Figure 33:
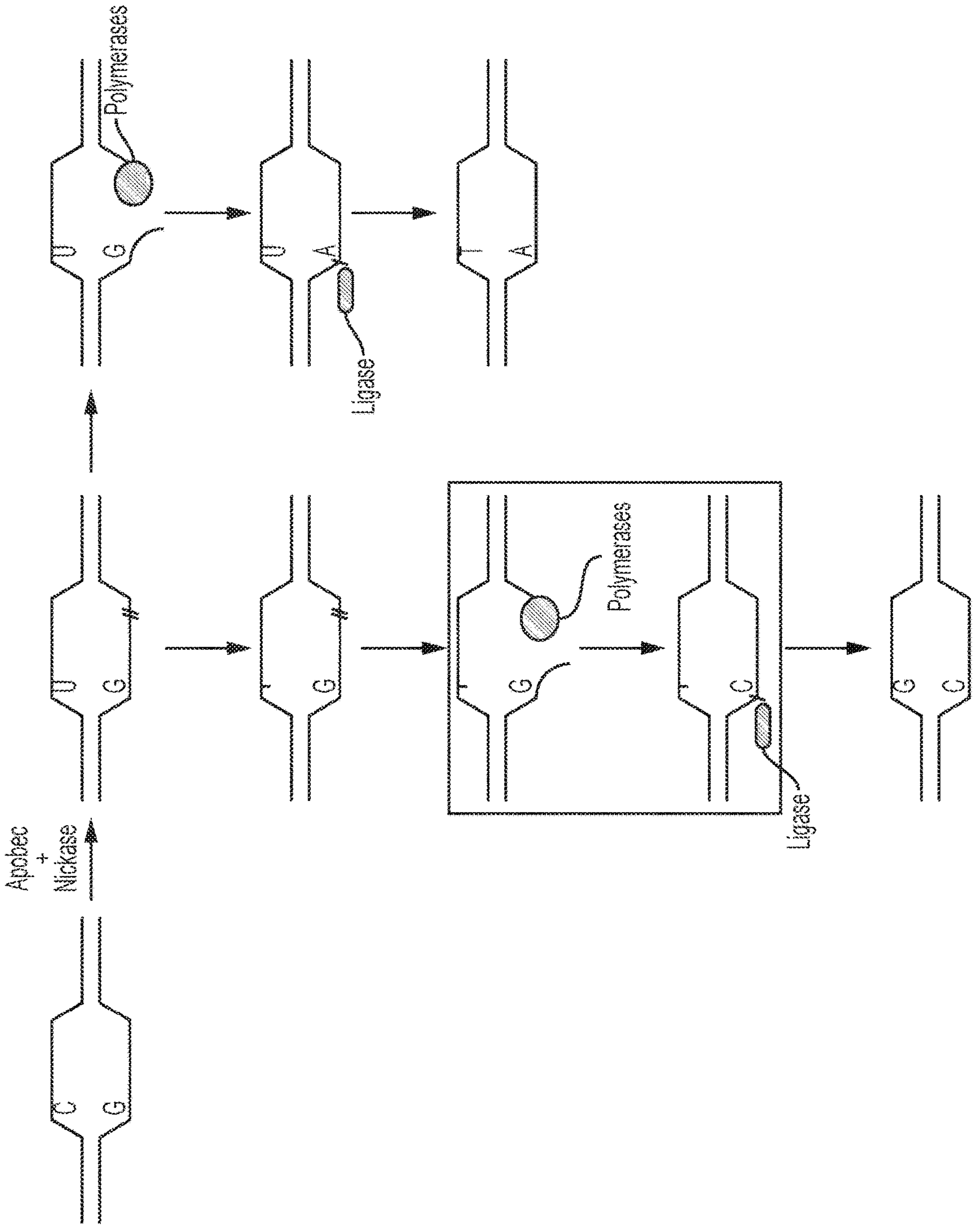
FIG. 33 shows a schematic illustrating an approach to increase in the incorporation of C opposite an abasic site, for C to G base editing. If the preference for C integration opposite an abasic site is increased, for example by using a polymerase (e.g., a translesion polymerase), the total C to G base editing will also be increased.
Figure 34:
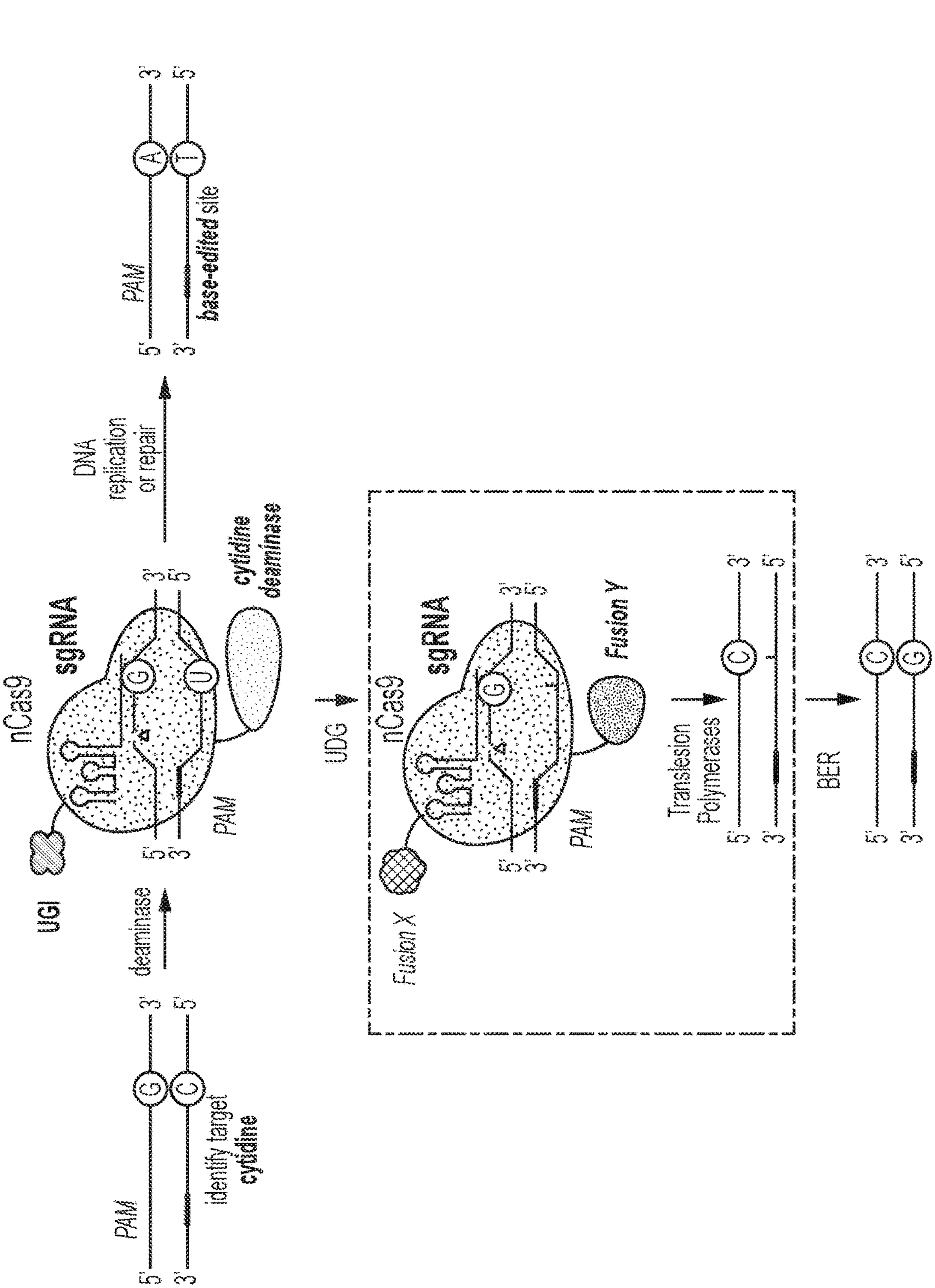
FIG. 34 shows a schematic illustrating an approach to increase in the incorporation of C opposite an abasic site, for C to G base editing. If the preference for C integration opposite an abasic site is increased, for example by incorporating a translesion polymerase into the base editor, the total C to G base editing may also be increased.
Figure 35:
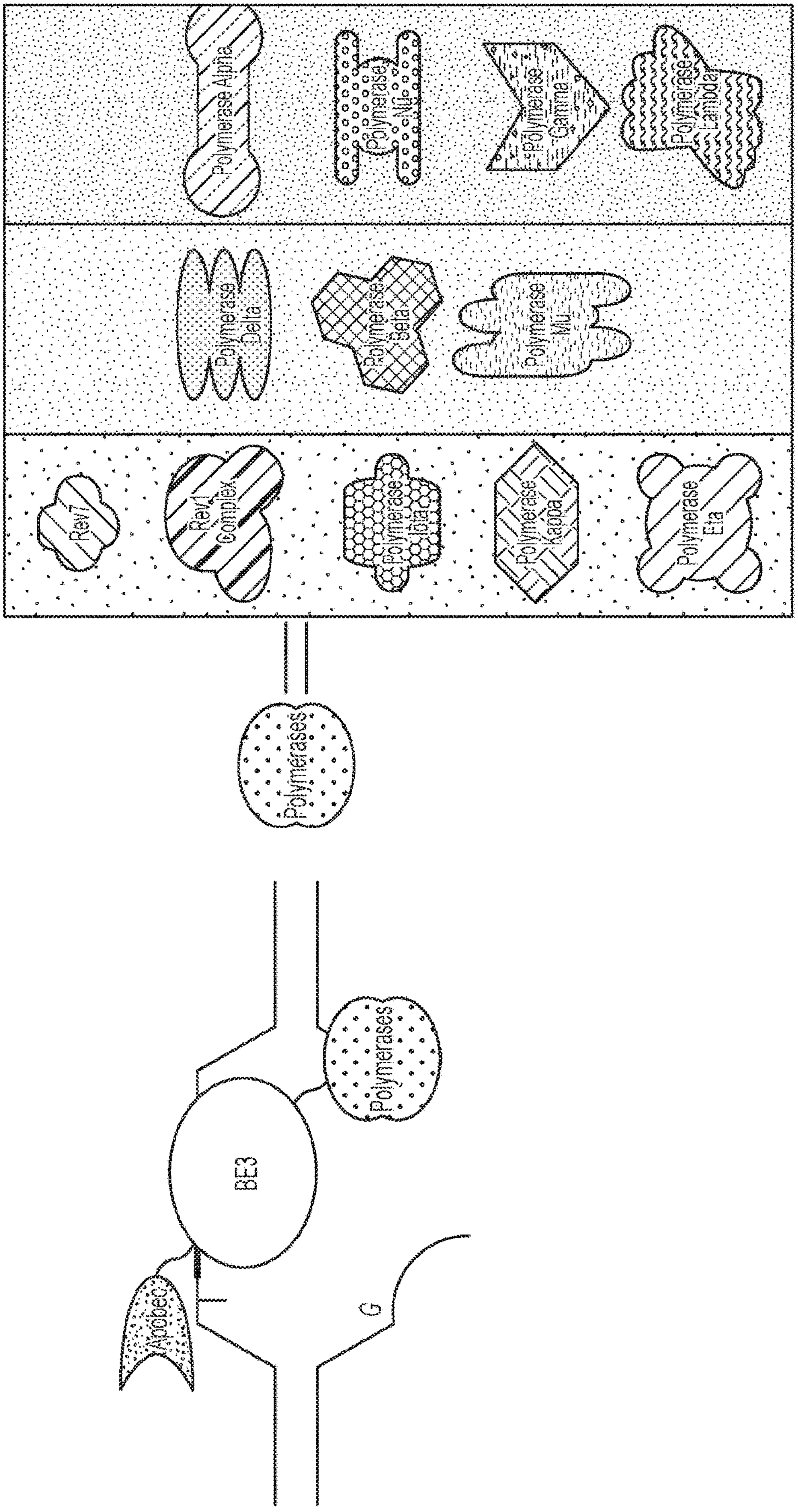
FIG. 35 shows a schematic illustrating the different polymerases that can be used in the C to G base editing approach of FIGS. 33 and 34.
Figure 36:
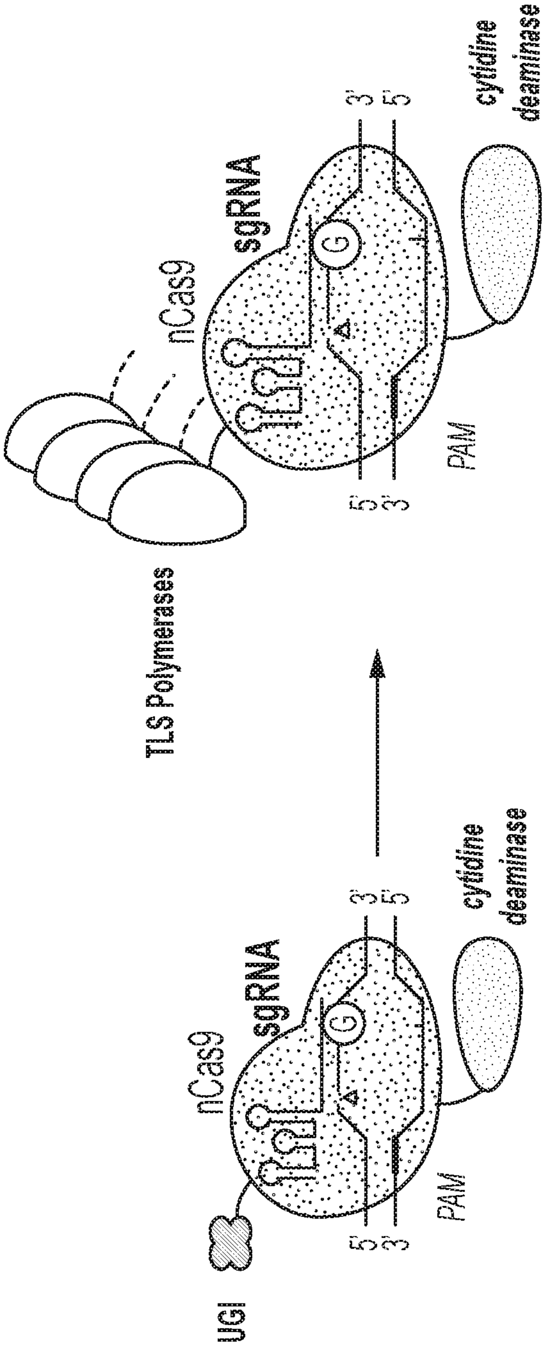
FIG. 36 shows a schematic (on the left) illustrating an exemplary C to T base editor (e.g., BE3), which contains a uracil glycosylase inhibitor (UGI), a Cas9 domain (e.g., nCas9), and a cytidine deaminase. On the right is a schematic illustrating a C to G base editor, which contains a translesion polymerase, a Cas9 domain (e.g., nCas9), and a cytidine deaminase.

Example 2: C to G Approach 2—Increase C Incorporation Opposite an Abasic Site An increase in the preference for C integration opposite an abasic site should lead to an increase in total C to G base editing. A schematic for this approach and base editors used in this approach is illustrated in FIGS. 33 and 34. Various polymerases that can be used in this approach for C to G base editing are shown in FIG. 35. Briefly Abasic site generation leads to C to non-T product formation. Rev1 has dC transferase activity. Eliminating this pathway or altering how abasic lesions are repaired should lead to new base editors. Rev1−/− knockout cell lines should lack C to G editing if this pathway is solely responsible for formation of this product. The fusion of various polymerases should lead to repair of the opposite strand based on polymerase preference for repair opposite an abasic sites leading to increased C to G base editing. Exemplary base editors are illustrated in FIG. 36.

Figure 37:
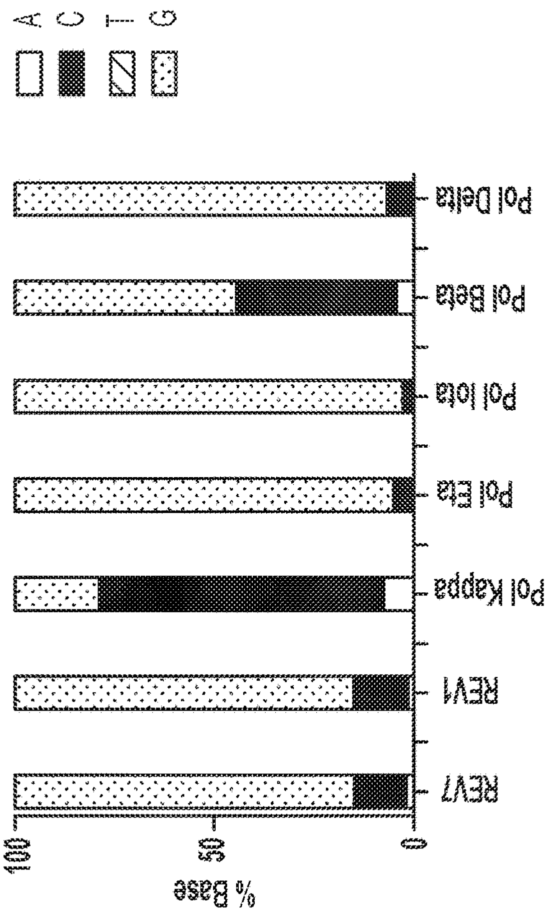
FIG. 37 shows base editing at the HEK2 site in WT cells using base editors tethered to REV1, Pol Kappa, Pol Eta, and Pol Iota. C to G editing is graphically shown by dotted bars (G) going to filled bars (C) in the graphical representation on the right panel. Pol Kappa tethering dramatically increases the efficiency of C to G editing. Raw editing values are shown on the left panel.
Figure 38:
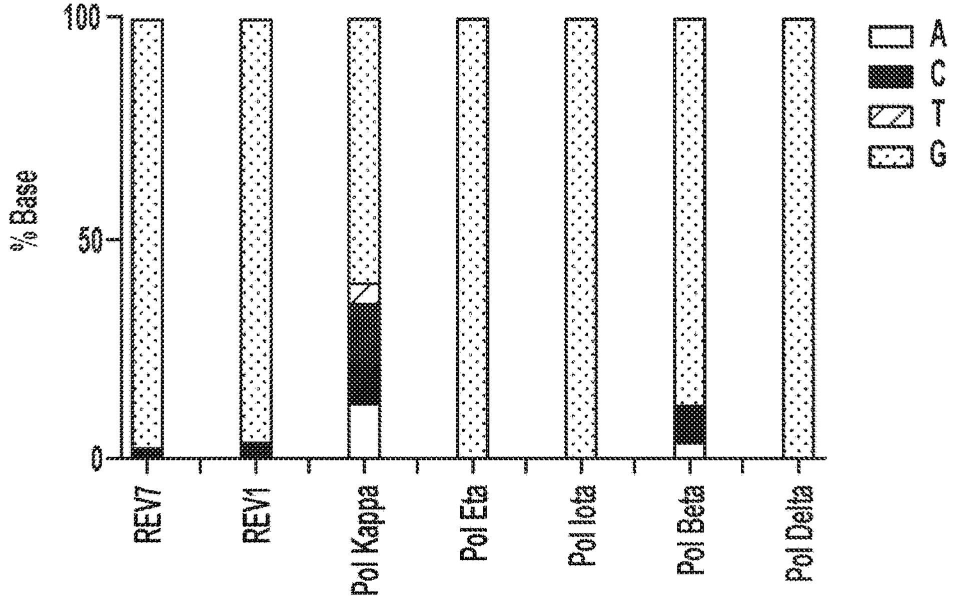
FIG. 38 shows base editing at the RNF2 site in WT cells using base editors tethered to REV1, Pol Kappa, Pol Eta, and Pol Iota. C to G editing is graphically shown by dotted bars (G) going to filled bars (C) in the graphical representation on the right panel. Pol Kappa tethering dramatically increases the efficiency of C to G editing. Raw editing values are shown on the left panel.
Figure 39:
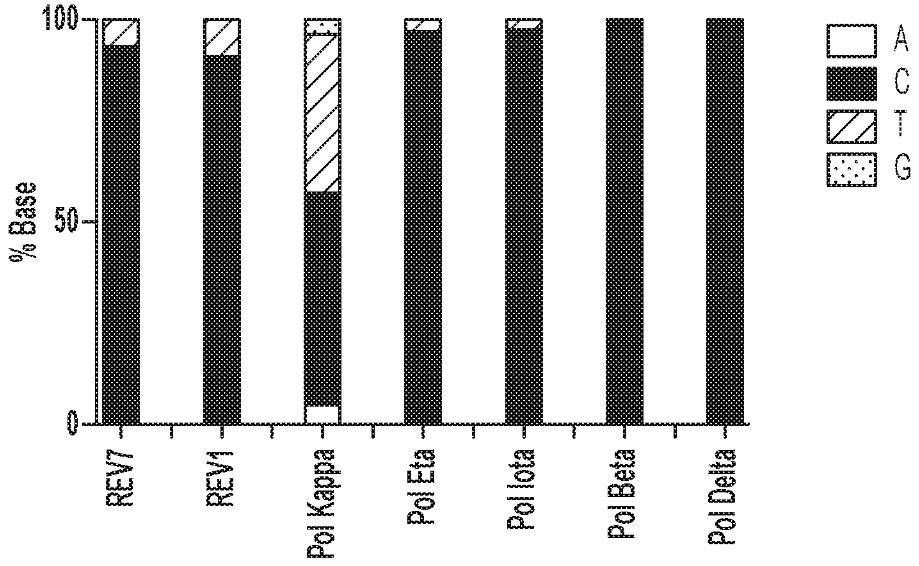
FIG. 39 shows base editing at the FANCF site in WT cells using base editors tethered to REV1, Pol Kappa, Pol Eta, and Pol Iota. C to G editing is graphically shown by filled bars (C) going to dotted bars (G) in the graphical representation on the right panel. Pol Kappa tethering dramatically increases the efficiency of C to G editing. Raw editing values are shown on the left panel.

Results of C to G base editing at HEK2, RNF2, and FANCF sites in WT cells using various base editors (BE3; BE3_UdgX; BE2_UdgX_On; BE3_UdgX_On; BE2_UDG; and BE3_UDG) are shown in FIGS. 37 through 39.

Steady-state Kinetic parameters for one-base incorporation opposite an abasic site and G by human polymerases η, ι, κ, and REV1 are given in Table 2. See, Choi et al. J mol Bio. 2010).

TABLE 2

Steady-state Kinetic parameters for polymerases η, τ, κ, and REV1

| Polymerase | Template | dNTP | $K_{on}$ (μM) | $k_{cat}$ ($s^{-1}$) | $k_{cat}/K_m$ ($mM^{-1}$ $s^{-1}$) | dNTP selectivity ratio[a] | Relative efficiency[b] |
|---|---|---|---|---|---|---|---|
| η | AP site | A | 40 ± 6 | 0.12 ± 0.004 | 3.0 | 0.95 | 0.065 |
| | | T | 290 ± 50 | 0.92 ± 0.05 | 3.2 | 1 | 0.070 |
| | | G | 8.5 ± 1.0 | 0.005 ± 0.0001 | 0.59 | 0.19 | 0.013 |
| | | C | 210 ± 20 | 0.14 ± 0.01 | 0.67 | 0.21 | 0.015 |
| | G | C | 2.6 ± 0.1 | 0.12 ± 0.005 | 46 | | 1 |
| τ | AP site | A | 210 ± 40 | 0.54 ± 0.04 | 2.6 | 0.45 | 1.4 |
| | | T | 130 ± 20 | 0.74 ± 0.02 | 5.7 | 1 | 3.0 |
| | | G | 120 ± 10 | 0.47 ± 0.01 | 3.9 | 0.69 | 2.1 |
| | | C | 570 ± 140 | 0.77 ± 0.05 | 1.4 | 0.24 | 0.74 |
| | G | C | 300 ± 30 | 0.57 ± 0.02 | 1.9 | | 1 |
| κ | AP site | A | 1600 ± 200 | 0.077 ± 0.005 | 0.048 | 0.77 | 0.00065 |
| | | T | 2300 ± 700 | 0.017 ± 0.002 | 0.0074 | 0.12 | 0.00010 |
| | | G | 400 ± 70 | 0.0032 ± 0.0002 | 0.008 | 0.13 | 0.00011 |
| | | C | 780 ± 220 | 0.049 ± 0.005 | 0.063 | 1 | 0.00085 |
| | G | C | 3.8 ± 0.5 | 0.28 ± 0.01 | 74 | | 1 |
| REV1 | AP site | A | 140 ± 50 | 0.000025 ± 0.000002 | 0.00018 | 0.0031 | 0.00019 |
| | | T | 190 ± 30 | 0.000072 ± 0.000003 | 0.00038 | 0.0067 | 0.00040 |
| | | G | 190 ± 50 | 0.000031 ± 0.000003 | 0.00016 | 0.0029 | 0.00017 |
| | | C | 210 ± 30 | 0.012 ± 0.001 | 0.057 | 1 | 0.061 |
| | G | C | 12.8 ± 50 | 0.012 ± 0.0003 | 0.94 | | 1 |

[a]dNTP selectivity ratio, calculated by dividing $k_{cat}/K_m$ for each dNTP incorporation by the highest $k_{cat}/K_m$ for dNTP incorporation opposite AP site.

[b]Relative efficiency, calculated by dividing $k_{cat}/K_m$ for each dNTP incorporation opposite AP site by $k_{cat}/K_m$ for dCTP incorporation opposite G.

Steady-state kinetic parameters for one-base incorporation opposite an abasic site and G by human polymerases α and δ/PCNA are given in Table 3.

TABLE 3

Steady-state Kinetic parameters for polymerases α and δ/PCNA
Steady-state kinetic parameters for one-base incorporation opposite an AP site and G by human pols α and δ/PCNA

| Polymerase | Template | dNTP | $K_m$ (μM) | $k_{cat}$ ($s^{-1}$) | $k_{cat}/K_m$ ($mM^{-1}$ $s^{-1}$) | dNTP selectivity ratio[a] | Relative efficiency[b] |
|---|---|---|---|---|---|---|---|
| α | AP site | A | 570 ± 100 | 0.0083 ± 0.0001 | 0.015 | 1 | 0.0010 |
| | | T | 250 ± 60 | 0.00046 ± 0.00003 | 0.0018 | 0.12 | 0.00012 |
| | | G | 550 ± 120 | 0.00024 ± 0.00002 | 0.0004 | 0.027 | 0.00003 |
| | | C | 980 ± 50 | 0.00047 ± 0.000001 | 0.0005 | 0.033 | 0.00003 |
| | G | C | 0.42 ± 0.09 | 0.0064 ± 0.0003 | 15 | | 1 |
| δ/PCNA | AP site | A | 25 ± 6 | 0.0067 ± 0.0004 | 0.27 | 1 | 0.012 |
| | | T | 62 ± 16 | 0.0060 ± 0.0004 | 0.097 | 0.36 | 0.0044 |
| | | G | 110 ± 20 | 0.010 ± 0.001 | 0.091 | 0.34 | 0.0041 |
| | | C | 880 ± 160 | 0.0069 ± 0.0006 | 0.0078 | 0.029 | 0.0004 |
| | G | C | 0.27 ± 0.05 | 0.0059 ± 0.0002 | 22 | | 1 |

[a]dNTP selectivity ratio, calculated by dividing $k_{cat}/K_m$ for each dNTP incorporation by the highest $k_{cat}/K_m$ for dNTP incorporation opposite AP site.
[b]Relative efficiency, calculated by dividing $k_{cat}/K_m$ for each dNTP incorporation opposite AP site by $k_{cat}/K_m$ for dCP incorporation opposite G.

TABLE 4

Polymerases that can be used for base editing approach 2.

| Polymerase | Size (Amino Acids) |
|---|---|
| Family X | |
| Beta | 335 |
| Lambda | 575 |
| Mu | 494 |
| Family B | |
| Alpha | 1462 |
| Delta | 1107 |
| Epsilon | 2286 |
| Family Y | |
| Eta | 713 |
| Iota | 740 |
| Kappa | 870 |
| Rev1 | 1251 |
| Zeta (Rev3/Rev7) | 3130 |

Figure 40:
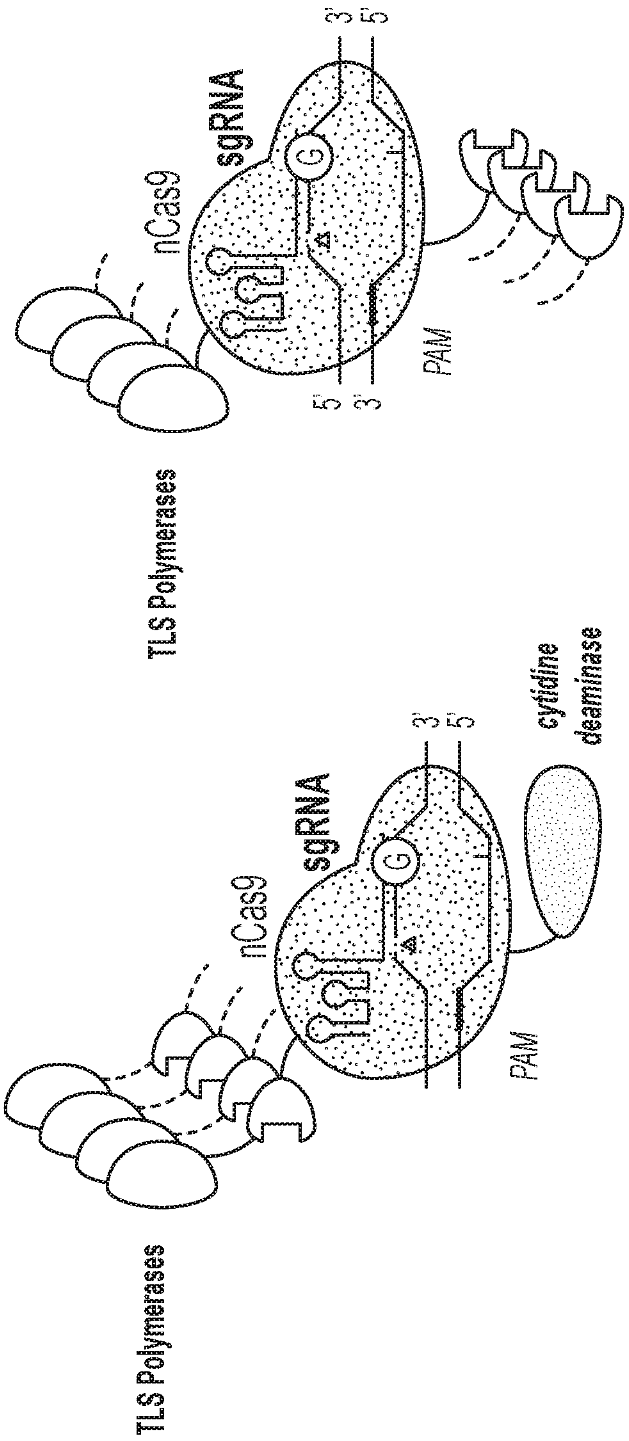
FIG. 40 shows a schematic (on the left) illustrating an exemplary C to G base editor, which contains a uracil DNA glycosylase (UDG), a translesion polymerase, a Cas9 domain (e.g., nCas9), and a cytidine deaminase. On the right is a schematic illustrating a C to G base editor, which contains a translesion polymerase, a Cas9 domain (e.g., nCas9), and a base excision enzyme (e.g., a UDG variant capable of excising a C or T residue).
Figure 41:
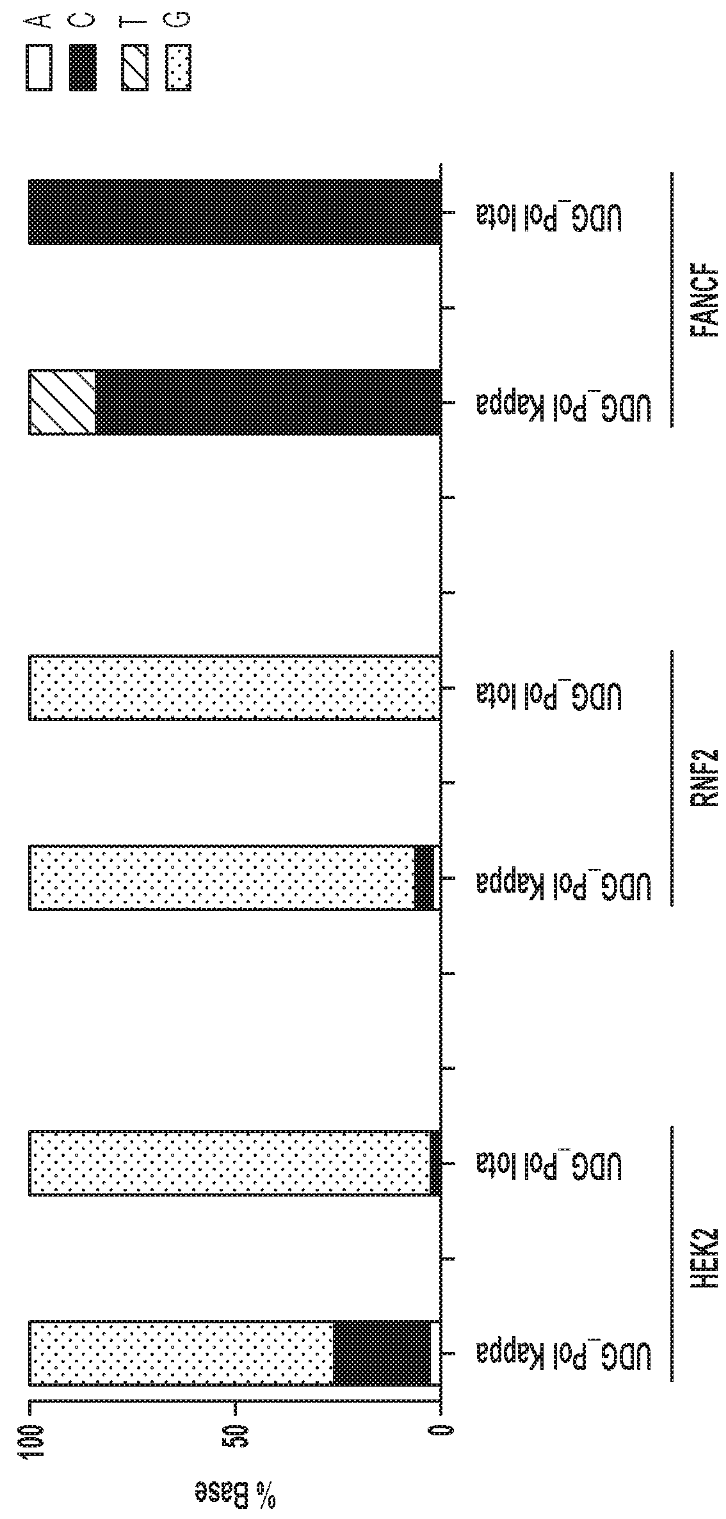
FIG. 41 shows C to G base editing using the base editor illustrated in the left panel of FIG. 40 (base editor containing a uracil DNA glycosylase (UDG), a translesion polymerase, a Cas9 domain, and a cytidine deaminase) at HEK2, RNF2, and FANCF sites using either Pol Kappa or Pol Iota tethered constructs. C to G editing is graphically shown by dotted bars (G) going to filled bars (C) for HEK2 and RNF2, and filled bars (C) going to dotted bars (G) for FANCF.
Figure 42:
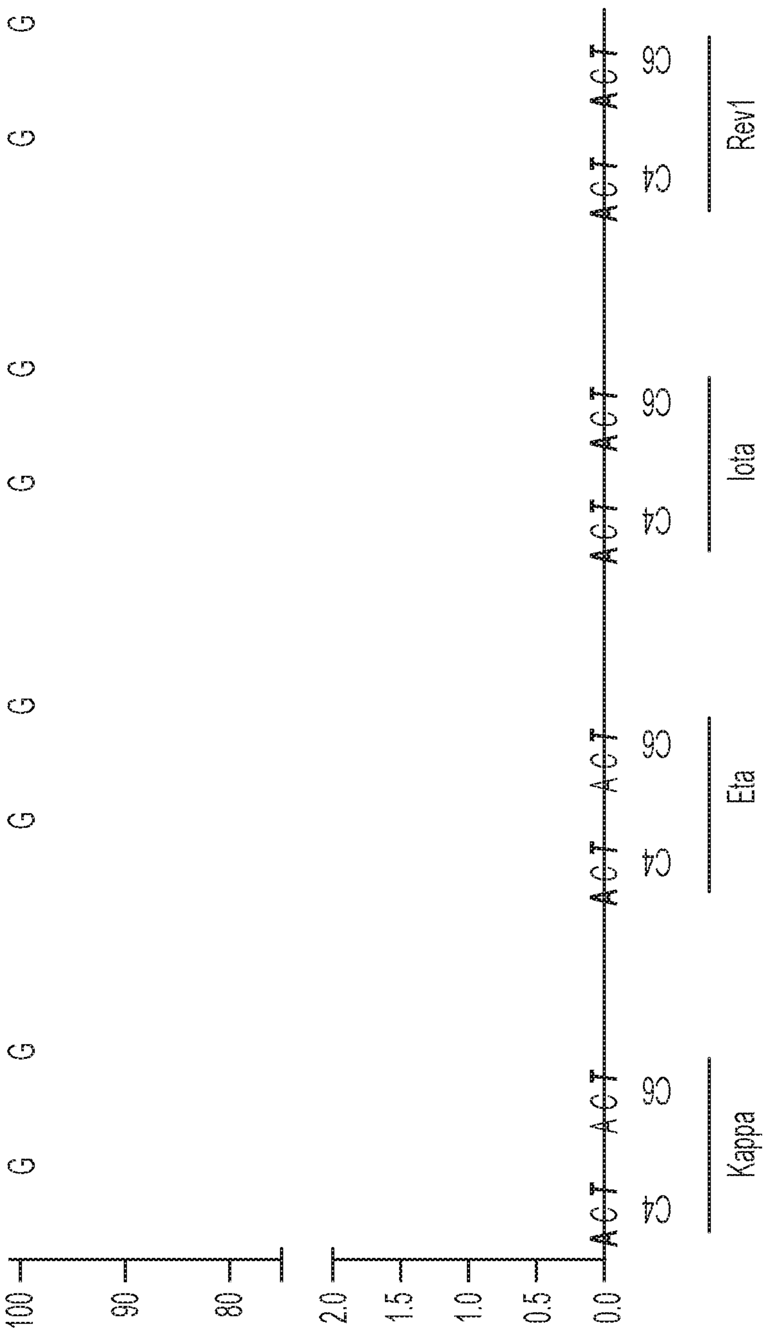
FIG. 42 shows base editing at the HEK2 site in WT cells using base editors tethered to either Pol Kappa, Pol Eta, Pol Iota, and REV1, which are shown in the right panel of FIG. 40 (base editor containing a translesion polymerase, a Cas9 domain, and base excision enzyme (UDG 147) which excises T). The amount C to G is graphically illustrated at specific residues in the HEK2 site. UDG 147 is a UDG variant that directly removes T.
Figure 43:
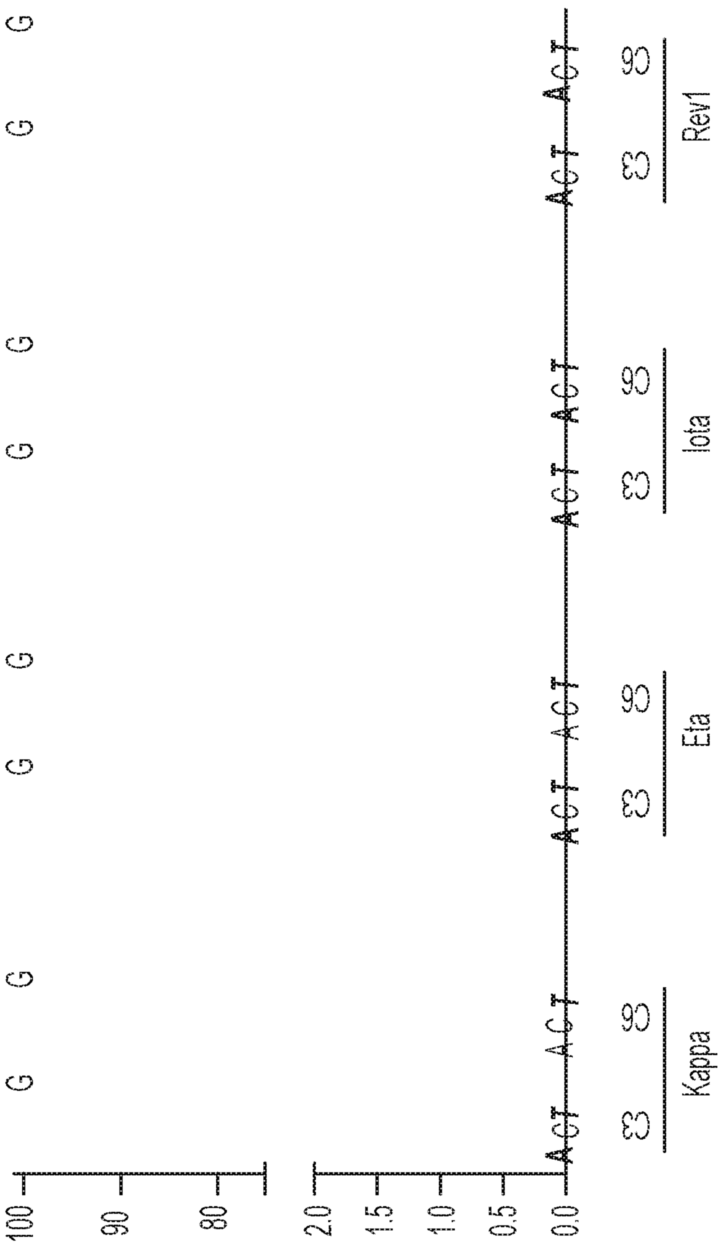
FIG. 43 shows base editing at the RNF2 site in WT cells using base editors tethered to either Pol Kappa, Pol Eta, Pol Iota, and REV1, which are shown in the right panel of FIG. 40 (base editor containing a translesion polymerase, a Cas9 domain, and base excision enzyme (UDG 147) which excises T). The amount C to G is graphically illustrated at specific residues in the HEK2 site. UDG 147 is a UDG variant that directly removes T.
Figure 44:
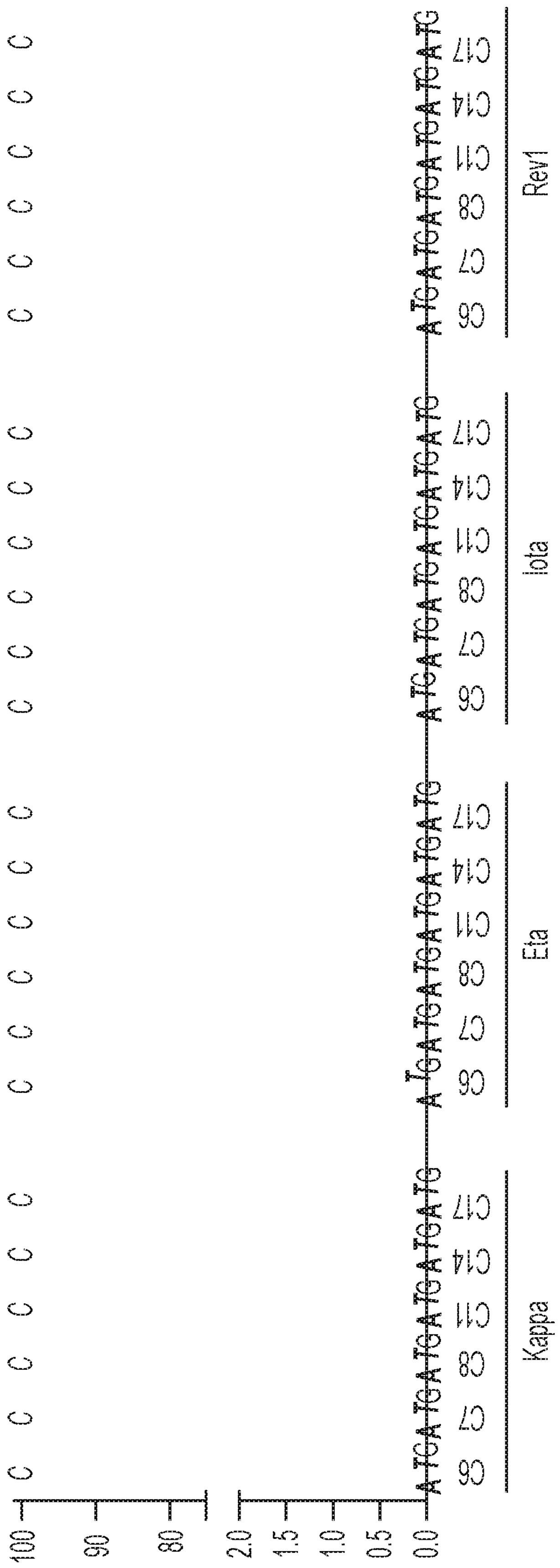
FIG. 44 shows base editing at the FANCF site in WT cells using base editors tethered to either Pol Kappa, Pol Eta, Pol Iota, and REV1, which are shown in the right panel of FIG. 40 (base editor containing a translesion polymerase, a Cas9 domain, and base excision enzyme (UDG 147) which excises T). The amount C to G is graphically illustrated at specific residues in the HEK2 site. UDG 147 is a UDG variant that directly removes T.
Figure 45:
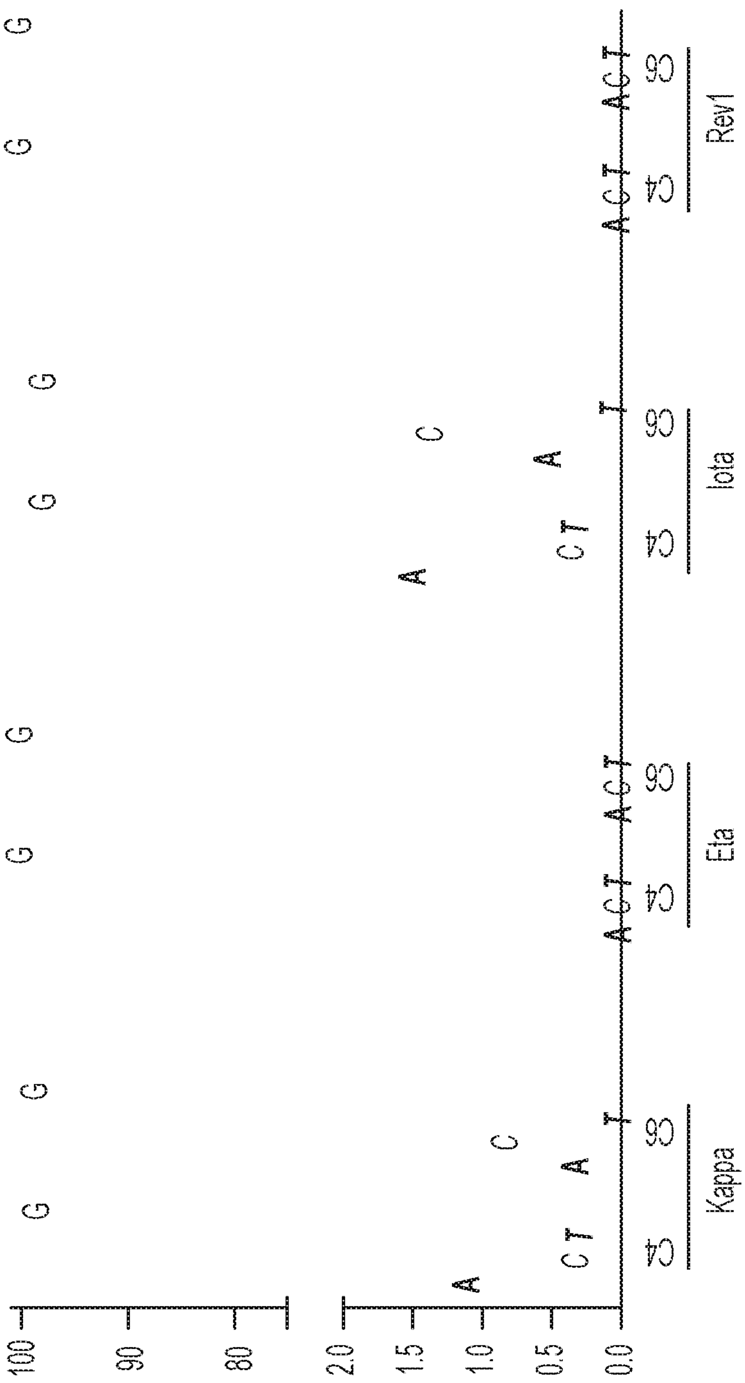
FIG. 45 shows base editing at the HEK2 site in WT cells using base editors tethered to either Pol Kappa, Pol Eta, Pol Iota, and REV1, which are shown in the right panel of FIG. 40 (base editor containing a translesion polymerase, a Cas9 domain, and base excision enzyme (UDG 204) which excises C). The amount C to G is graphically illustrated at specific residues in the HEK2 site. UDG 204 is a UDG variant that directly removes C.
Figure 46:
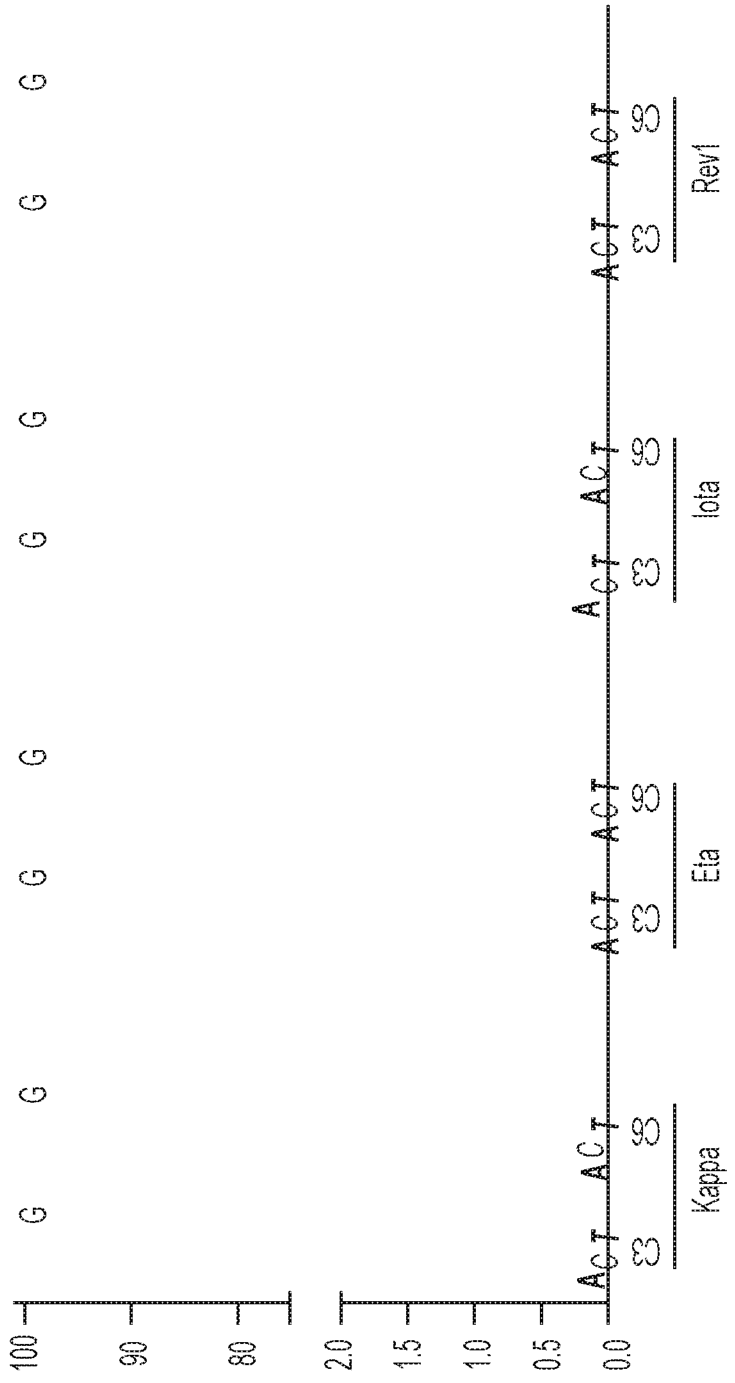
FIG. 46 shows base editing at the RNF2 site in WT cells using base editors tethered to either Pol Kappa, Pol Eta, Pol Iota, and REV1, which are shown in the right panel of FIG. 40 (base editor containing a translesion polymerase, a Cas9 domain, and base excision enzyme (UDG 204) which excises C). The amount C to G is graphically illustrated at specific residues in the HEK2 site. UDG 204 is a UDG variant that directly removes C.
Figure 47:
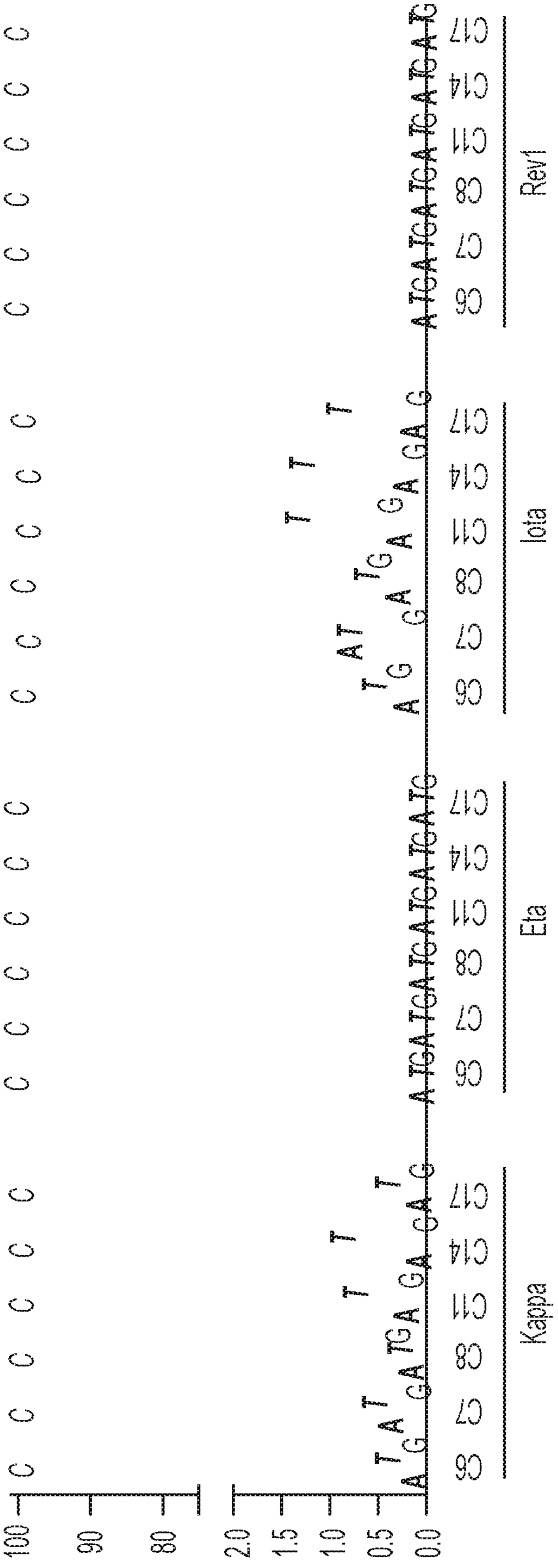
FIG. 47 shows base editing at the FANCF site in WT cells using base editors tethered to either Pol Kappa, Pol Eta, Pol Iota, and REV1, which are shown in the right panel of FIG. 40 (base editor containing a translesion polymerase, a Cas9 domain, and base excision enzyme (UDG 204) which excises C). The amount C to G is graphically illustrated at specific residues in the HEK2 site. UDG 204 is a UDG variant that directly removes C.

Example 3: C to G Approach 3—Increase Both Abasic Site Formation and C Incorporation A schematic of a base editor for increasing both abasic site formation and C incorporation for increased C to G base editing is illustrated in FIG. 40. Addition of polymerase tethered constructs, particularly Pol Kappa, increases C to G base editing. Results of base editing at the HEK2, RNF2, and FANCF sites using either Pol Kappa for Pol Iota tethered constructs is shown in FIG. 41. Results of base editing using additional polymerase tethered constructs in WT cells at cytosine residues in the HEK2, RNF2, and FANCF sites are shown in FIGS. 42 through 47. UDG 147 is an enzyme that directly removes T and increases the C to G base editing (FIGS. 42 through 44), while UDG 204 is an enzyme that directly removes C and increases C to G base editing (FIGS. 45 through 47).

Figure 48:
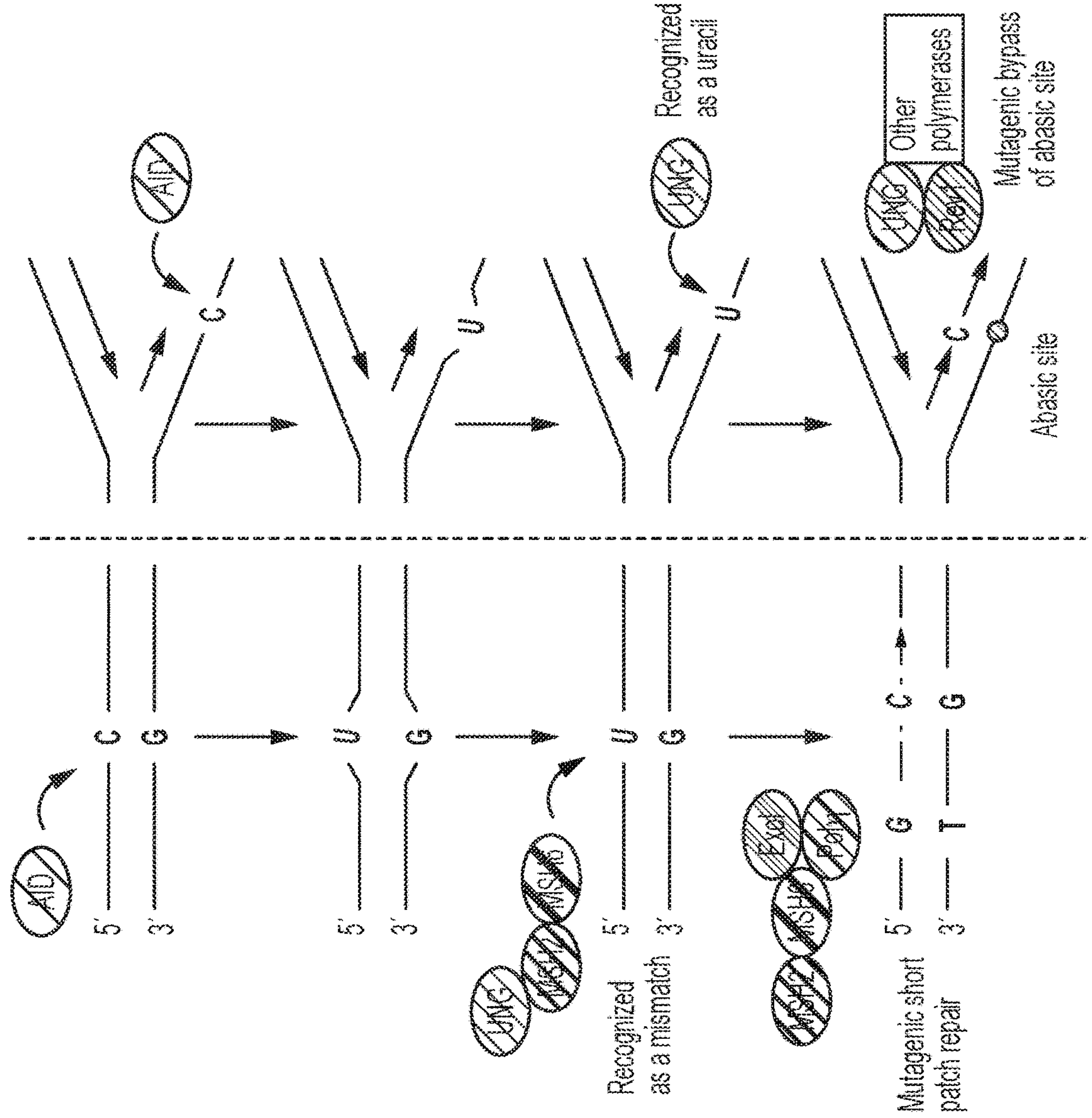
FIG. 48 shows a schematic illustrating a role of MSH2 in base repair, where MSH2 may facilitate the conversion of a uracil (U) to a cytosine (C) in DNA.
Figure 49:
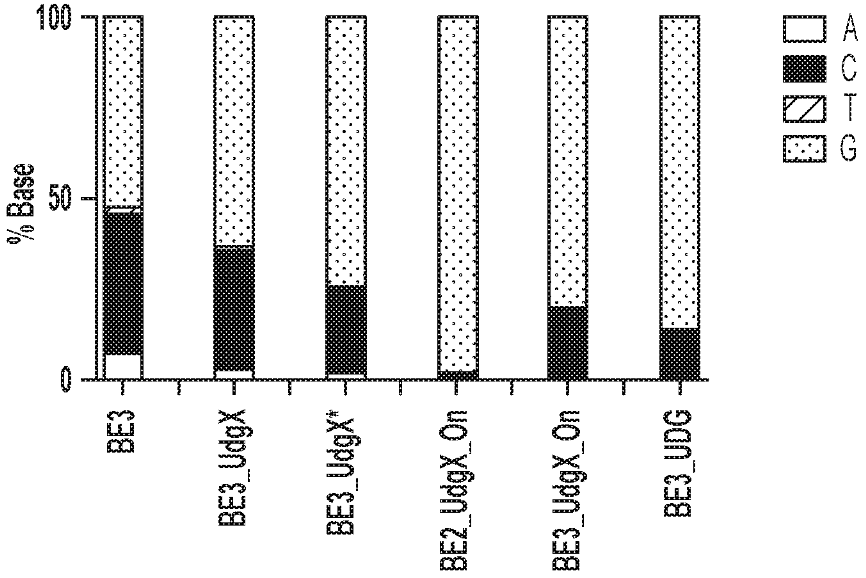
FIG. 49 shows base editing at the HEK2 site in MSH2−/− cells using six base editors (BE3; BE3_UdgX; BE3_UdgX*; BE2_UdgX_On; BE3_UdgX_On; and BE3_UDG). Raw editing values are shown in the left panel. The panel on the right shows a graphical representation of the raw editing values, where C to G base editing is graphically shown by dotted bars (G) going to filled bars (C).
Figure 50:
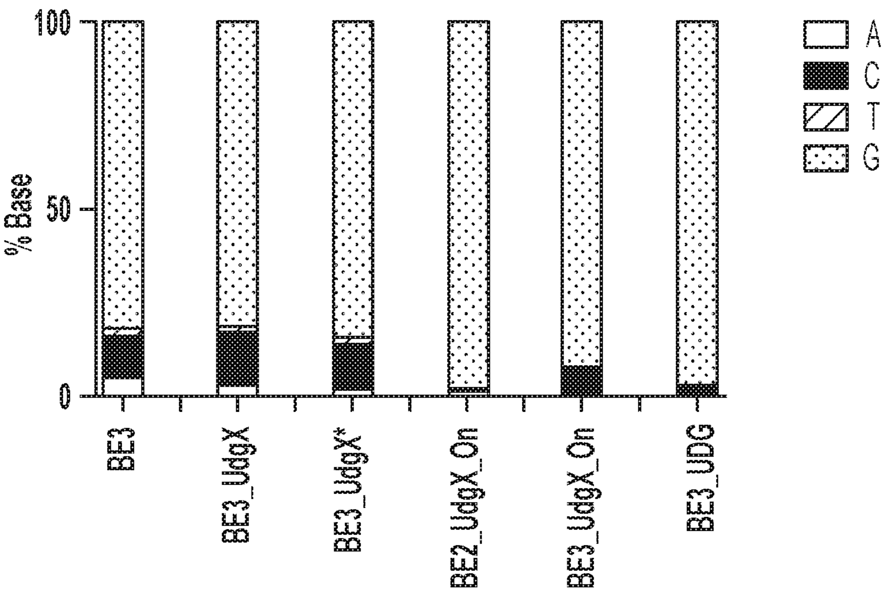
FIG. 50 shows base editing at the RNF2 site in MSH2−/− cells using six base editors (BE3; BE3_UdgX; BE3_UdgX*; BE2_UdgX_On; BE3_UdgX_On; and BE3_UDG). Raw editing values are shown in the left panel. The panel on the right shows a graphical representation of the raw editing values, where C to G base editing is graphically shown by dotted bars (G) going to filled bars (C).
Figure 51:
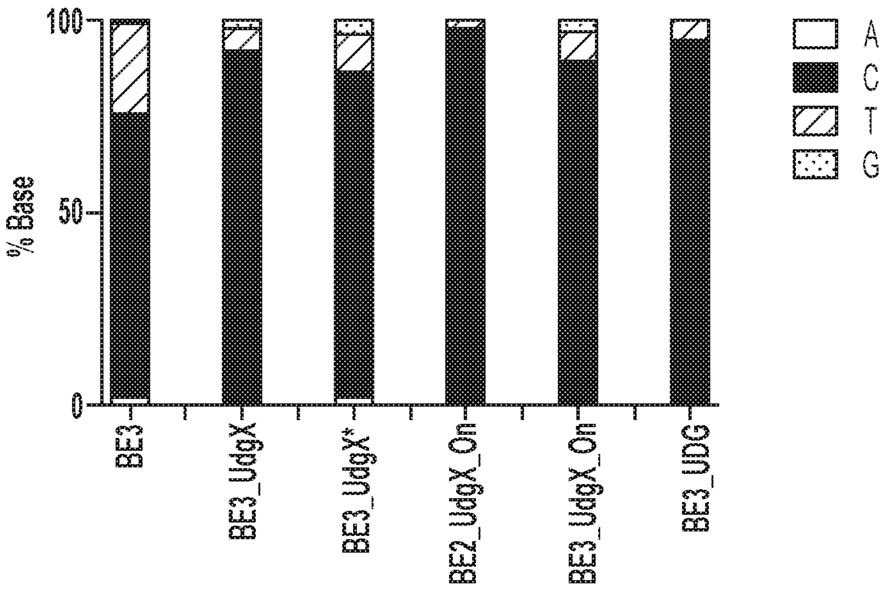
FIG. 51 shows base editing at the FANCF site in MSH2−/− cells using six base editors (BE3; BE3_UdgX; BE3_UdgX*; BE2_UdgX_On; BE3_UdgX_On; and BE3 UNG). Raw editing values are shown in the left panel. The panel on the right shows a graphical representation of the raw editing values, where C to G base editing is graphically shown by filled bars (C) going to dotted bars (G).

Example 4: C to G Approach 4—Eliminate Alternative Repair Pathways to Increase C to G Flux One way to improve C to G editing is to eliminate or downmodulate alternative repair pathways. AS one example, eliminating the repair pathway protein $MSH2^{-/-}$ may lead to an increase in C to G base editing is shown in FIG. 48. The results of C to G base editing at HEK2, RNF2, and FANCF sites in $MSH2^{-/-}$ cells using various base editors (BE3; BE3_UdgX; BE2_UdgX_On; BE3_UdgX_On; BE2_UDG; and BE3_UDG) are shown in FIGS. 49 through 51.

Example 5: C to G Approach 5—Expression of Components in Trans

Figure 52:
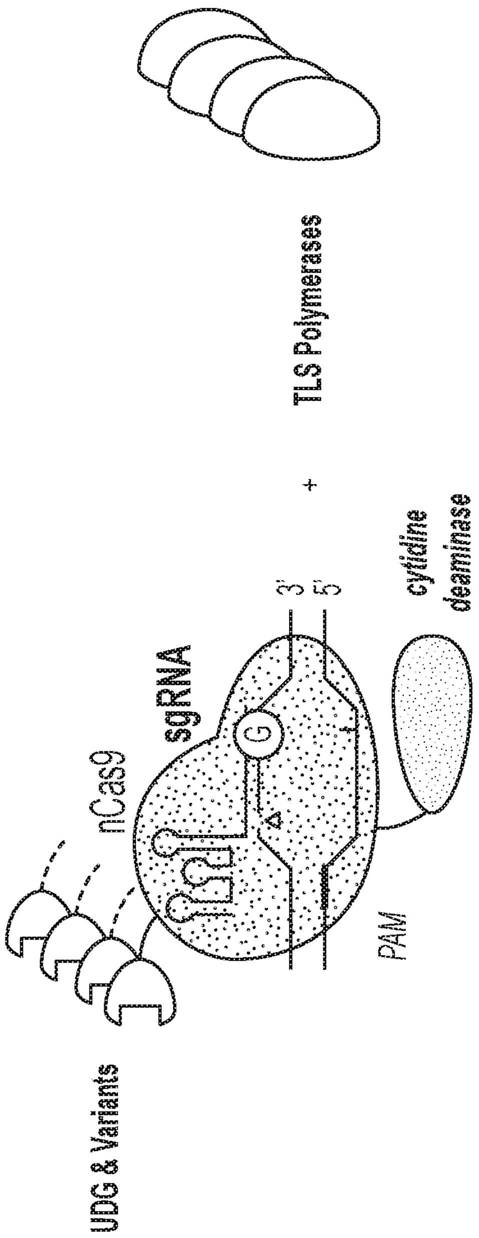
FIG. 52 shows a schematic illustrating a base editing approach where a C to G base editor containing a UDG (or a UDG variant), a Cas9 (e.g., nCas9) domain, and a cytidine deaminase is expressed in trans with a translesion polymerase.

One approach for identifying base editor components that function together is to express those components together in a cell, in trans. Once base editor components (e.g., polymerases, uracil binding proteins, base excision enzymes, cytidine deaminases, and/or nucleic acid programmable DNA binding proteins) that induce C to G mutations are identified, they can be tethered to generate base editors. Expressed UDG and UdgX variants fused to APOBEC-Cas9 nickase and simultaneously overexpressed TLS polymerases in trans lead to C to G editing at the RNF2 site. A schematic illustrating the expression of components in trans is shown in FIG. 52.

Figure 53:
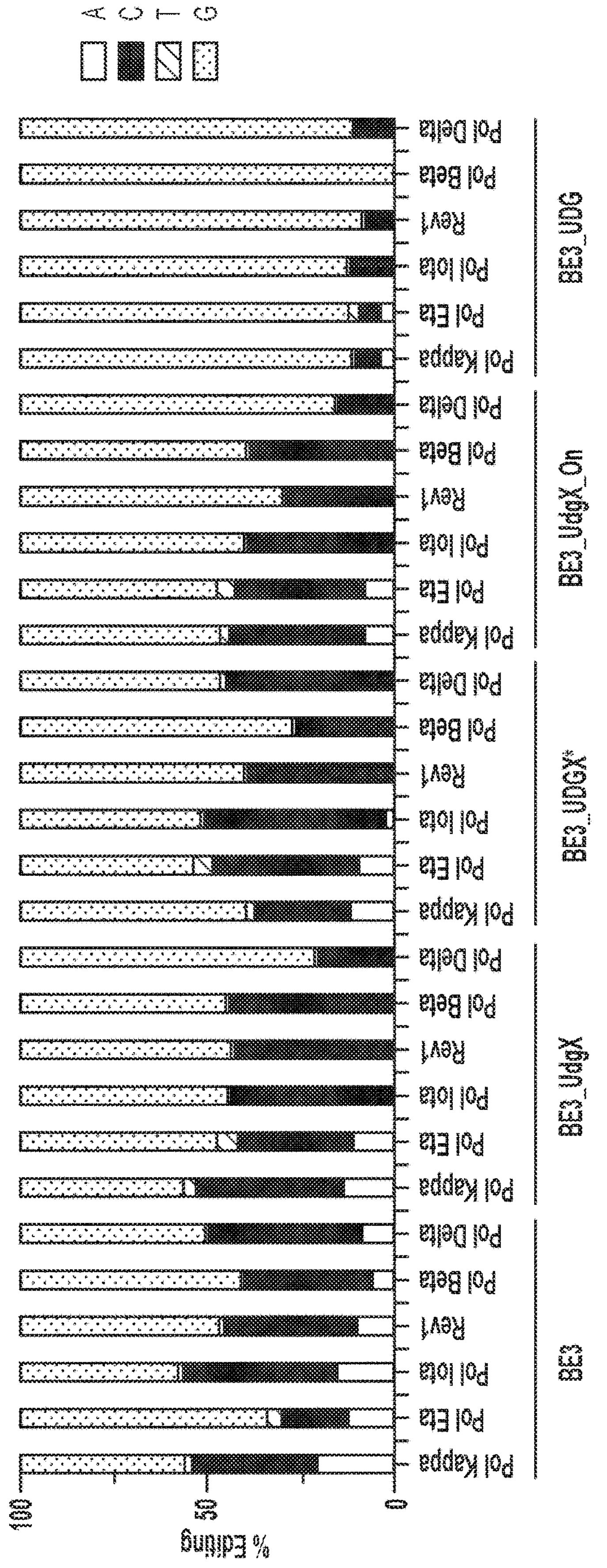
FIG. 53 shows base editing at the HEK2 site in HEK293 cells using five base editors (BE3; BE3_UdgX; BE3_UdgX*; BE2_UdgX_On; and BE3_UDG) expressed, in trans, with various polymerases (Pol Kappa, Pol Eta, Pol Iota, REV1, Pol Beta, and Pol Delta). C to G base editing is graphically shown by dotted bars (G) going to filled bars (C).
Figure 54:
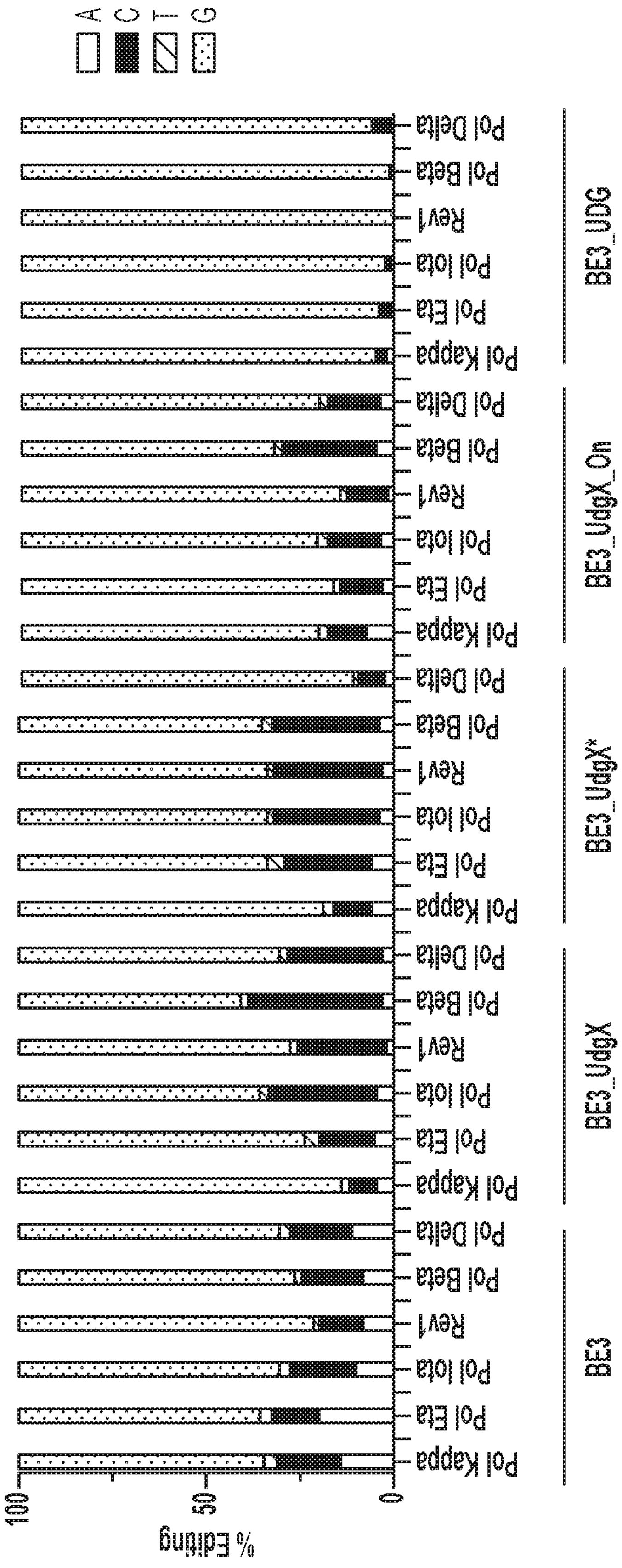
FIG. 54 shows base editing at the RNF2 site in HEK293 cells using five base editors (BE3; BE3_UdgX; BE3_UdgX*; BE2_UdgX_On; and BE3_UDG) expressed, in trans, with various polymerases (Pol Kappa, Pol Eta, Pol Iota, REV1, Pol Beta, and Pol Delta). C to G base editing is graphically shown by dotted bars (G) going to filled bars (C).
Figure 55:
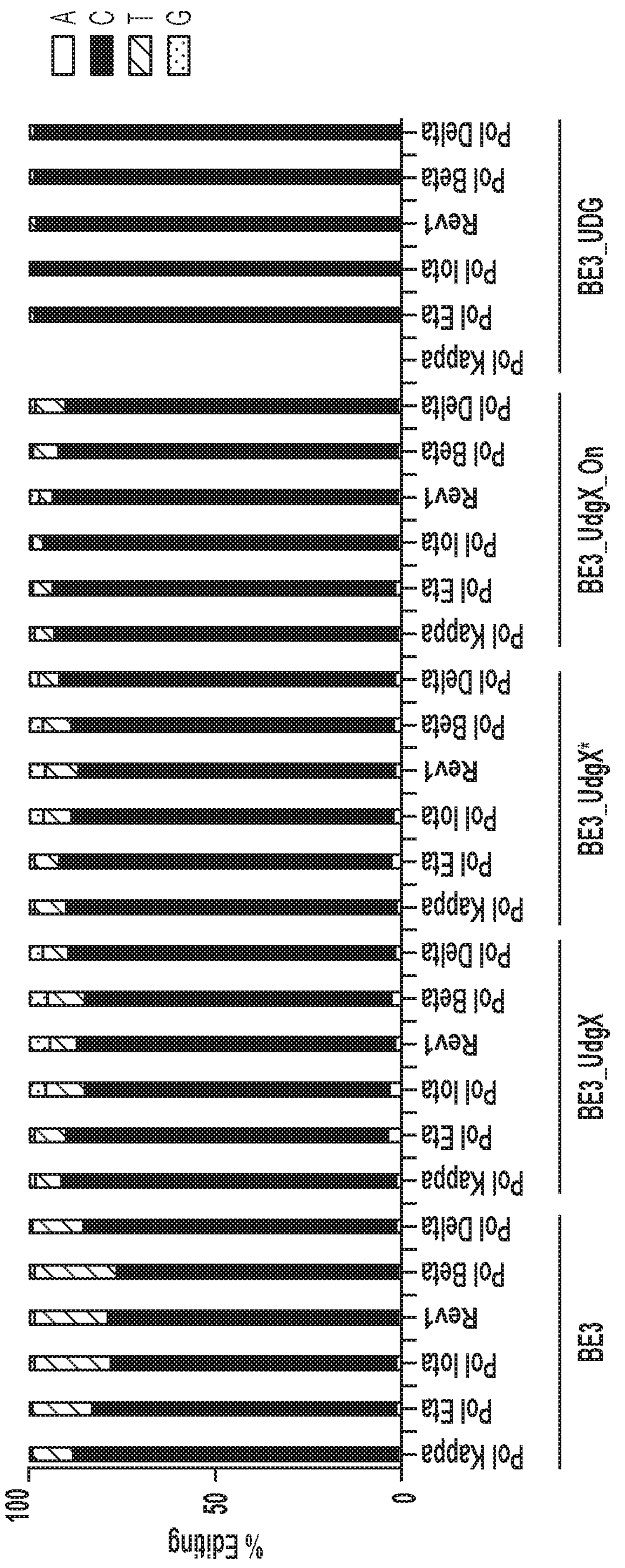
FIG. 55 shows base editing at the FANCF site in HEK293 cells using five base editors (BE3; BE3_UdgX; BE3_UdgX*; BE2_UdgX_On; and BE3_UDG) expressed, in trans, with various polymerases (Pol Kappa, Pol Eta, Pol Iota, REV1, Pol Beta, and Pol Delta). C to G base editing is graphically shown by filled bars (C) going to dotted bars (G).

Results of base editing at HEK2, RNF2, and FANCF in HEK293 cells using five different base editors (BE3; BE3_UdgX; BE2_UdgX_On; BE3_UdgX_On; BE2_UDG; and BE3_UDG) expressed, in trans, with various polymerases (Pol Kappa, Pol Eta, Pol Iota, REV1, Pol Beta, and Pol Delta) are shown in FIGS. 53 through 55.

REFERENCES

1. Chan, K., Resnick, M. A., Gordenin, D. A. The choice of nucleotide inserted opposite abasic sites formed within chromosomal DNA reveals the polymerase activities participating in translesion DNA synthesis. *DNA Repair* 12, 878-889 (2013).

2. Choi, J. Y., Lim, S., Kim, E. J., Jo, A., and Guengerich F. P. Translesion synthesis across abasic lesions by human B-family and Y-family DNA polymerases alpha, delta, eta, iota, kappa, and Rev1. *Journal of Molecular Biology* 404, 34-44 (2010).
3. Dianov, G. L. and Hubsher U. Mammalian base excision repair: the forgotten archangel. *Nucleic Acids Research,* 1-8 (2013).
4. Fortini, P., Pasucci, B., Sobol, R. W., Wilson, S. H., and Dogliotti, E. Different DNA polymerases are involved in the Short- and lon-patch base excision repair in mammalian cells. *Biochemistry* 37, 3575-3580 (1998).
5. Jiricny, J. The multifaceted mismatch-repair system. *Nature Rev. Molecular Cell Biology* 7, 335-346 (2006).
6. Katafuchi A. and Nohmi T. DNA polymerases involved in the incorporation of oxidized nucelotides into DNA: their efficiency and template base preference. *Mutation Research* 703, 24-31 (2010).
7. Kavli, B., Slupphaug, G., Mol, C. D., Arvai, A. S., Peterson, S. B., Tainer, J. A., and Krokan, E. H. Excision of cytosine and thymine from DNA by mutants of human uracil-DNA glycosylase. *EMBO* 15, 3442-3447 (1996).
8. Krokan, H. E. and Bjoras, M. Base Excision Repair, *Cold Spring Harbor Perspectives in Biology,* 1-22 (2013).
9. Kunkel, T. A. and Erie, D. A. Eukaryotic mismatch repair in relation to RNA replication. *Annual Reviews Genetics* 49, 291-313 (2015).
10. Li, G. M. Mechanisms and functions of DNA mismatch repair. *Cell Research* 18, 85-98 (2008).
11. Lin, W., Xin, H., Wu, X., Yuan, F., and Wang, Z. The human REV1 gene codes for a DNA template-dependent dCMP transferase. *Nucleic Acids Research* 27, 4468-4475 (1999).
12. Mol, C. D., Arvai, A. S., Slupphaug, G., Kavil, B., Alseth, I., Krokan, H. E., and Tainer, J. A. Crystal structure and mutational analysis of human uracil-DNA glycosylase: structural basis for specificity and catalysis. *Cell* 80, 869-878 (1995).
13. Prasad, R., Poltoratsky, V., Hou, E. W., and Wilson, S. H. Rev1 is a base excision repair enzyme with 5' deoxyribose phosphate lyase activity. *Nucleic Acid Research,* 1-10 (2016).
14. Robertson, A. B., Klungland, A., Rognes, T., and Leiros, I. Base excision repair: the long and the short of it. *Cell Molecular Life Sciences* 66, 981-993 (2009).
15. Sale, J. E., Lehmann, A. R., and Woodgate, R. Y-Family DNA polymerases and their role in tolerance of cellular DNA damage. *Nature Rev. Molecular Cell Biology* 13, 141-152 (2012).
16. Sang, P. B., Srinath, T., Patil, A. G., Woo, E. J., and Varshney, U. A unique uracil-DNA binding protein of the uracil DNA glycosylase superfamily. *Nucleic Acids Research,* 1-12 (2015).
17. Savva, R., McAuley-Hecht, K., Brown, T., and Pearl, L. The structural basis of specific base-excision repair by uracil-DNA glycosylase. *Nature* 373, 487-493 (1995).
18. Slupphaug, G., Mol, C. D., Kavli, B., Arvai, A. S., Krokan, H. E., and Tainer, J. A. A nucleotide-flipping mechanism from the structure of human uracil-DNA glycosylase bound to DNA. *Nature* 384, 87-92 (1996).
19. Weill, J. C. and Reynaud C. A. DNA polymerases in adaptive immunity. *Nature Rev. Immunology* 8, 302-312 (2008).
20. Yasui, A. Alternative excision repair pathways. *Cold Spring Harbor Perspectives in Biology,* 1-8 (2013).

Example 6:—Cas9 Variant Sequences

The disclosure provides Cas9 variants, for example Cas9 proteins from one or more organisms, which may comprise one or more mutations (e.g., to generate dCas9 or Cas9 nickase). In some embodiments, one or more of the amino acid residues, identified below by an asterek, of a Cas9 protein may be mutated. In some embodiments, the D10 and/or H840 residues of the amino acid sequence provided in SEQ ID NO: 6, or a corresponding mutation in any Cas9 provided herein, such as any one of the amino acid sequences provided in SEQ ID NOs: 4-26, are mutated. In some embodiments, the D10 residue of the amino acid sequence provided in SEQ ID NO: 6, or a corresponding mutation in any Cas9 provided herein, such as any of the amino acid sequences provided in SEQ ID NOs: 4-26, is mutated to any amino acid residue, except for D. In some embodiments, the D10 residue of the amino acid sequence provided in SEQ ID NO: 6, or a corresponding mutation in any Cas9, such as any one of the amino acid sequences provided in SEQ ID NOs: 4-26, is mutated to an A. In some embodiments, the H840 residue of the amino acid sequence provided in SEQ ID NO: 6, or a corresponding residue in any Cas9, such as any of the amino acid sequences provided in SEQ ID NOs: 4-26, is an H. In some embodiments, the H840 residue of the amino acid sequence provided in SEQ ID NO: 6, or a corresponding mutation in any Cas9, such as any of the amino acid sequences provided in SEQ ID NOs: 4-26, is mutated to any amino acid residue, except for H. In some embodiments, the H840 residue of the amino acid sequence provided in SEQ ID NO: 6, or a corresponding mutation in any Cas9, such as any of the amino acid sequences provided in SEQ ID NOs: 4-26, is mutated to an A. In some embodiments, the D10 residue of the amino acid sequence provided in SEQ ID NO: 6, or a corresponding residue in any Cas9, such as any of the amino acid sequences provided in SEQ ID NOs: 4-26, is a D.

Cas9 sequences from various species were aligned to determine whether corresponding homologous amino acid residues of D10 and H840 of SEQ ID NO: 6 can be identified in other Cas9 proteins, allowing the generation of Cas9 variants with corresponding mutations of the homologous amino acid residues. The alignment was carried out using the NCBI Constraint-based Multiple Alignment Tool (COBALT(accessible at st-va.ncbi.nlm.nih.gov/tools/cobalt), with the following parameters. Alignment parameters: Gap penalties −11,−1; End−Gap penalties −5,−1. CDD Parameters: Use RPS BLAST on; Blast E-value 0.003; Find Conserved columns and Recompute on. Query Clustering Parameters: Use query clusters on; Word Size 4; Max cluster distance 0.8; Alphabet Regular.

An exemplary alignment of four Cas9 sequences is provided below. The Cas9 sequences in the alignment are: Sequence 1 (S1): SEQ ID NO: 23|WP_0109222511 gi 499224711|type II CRISPR RNA-guided endonuclease Cas9 [*Streptococcus pyogenes*]; Sequence 2 (S2): SEQ ID NO: 24|WP_039695303|gi 746743737|type II CRISPR RNA-guided endonuclease Cas9 [*Streptococcus* gallolyticus]; Sequence 3 (S3): SEQ ID NO: 25|WP_045635197|gi 782887988|type II CRISPR RNA-guided endonuclease Cas9 [*Streptococcus mitis*]; Sequence 4 (S4): SEQ ID NO: 26|5AXW_A|gi 924443546|*Staphylococcus Aureus* Cas9. The HNH domain (bold and underlined) and the RuvC domain (boxed) are identified for each of the four sequences. Amino acid residues 10 and 840 in S1 and the homologous amino acids in the aligned sequences are identified with an asterisk following the respective amino acid residue.

| | | | |
|---|---|---|---|
| S1 | 1 | --MDKK-**YSIGLD*IGTNSVGWAVITDEYKVESKKEKVLGNTDRESIKENLI--GALLFDSG--ET**AEATRLKRTARRRYT | 73 |
| S2 | 1 | --MTKKN**YSIGLD*IGTNSVGWAVITDDYKVPAKKMKVIGNTDKEYIKENLL--GALLFDSG--ET**AKATRLKRTARRRYT | 74 |
| S3 | 1 | --M-KKG**YSIGLD*IGTNSVGFAVITDDYKVPSKKMKVLGNTDKRFIKKNLI--GALLFDEG--TT**AEARRLKRTARRRYT | 73 |
| S4 | 1 | GSHMKRN**YILGLD*IGITSVGYGII--DYET-----------------RDVIDAGVRLFKEANVEN**NEGRRSKRGARRLKR | 61 |
| S1 | 74 | RRKNRICYLQEIFSNEMAKVDDSFFHRLEESFLVEEDKKHERHPIFGNIVDEVAYHEKYPTIYHLRKKLVDSTDKADLRL | 153 |
| S2 | 75 | RRKNRLRYLQEIFANEIAKVDESFFQRLDESFLTDDDKTEDSHPIFGNKAEEDAYHQKFPTIYHLRKHLADSSEKADLRL | 154 |
| S3 | 74 | RRKNRLRYLQEIFSEEMSKVDSSFFHRLDDSFLIPEDKRESKYPIFATLTEEKEYHKQFPTIYHLRKQLADSKEKTDLRL | 153 |
| S4 | 62 | RRRHRIQRVKKLL-------------FDYNLLTD-------------------HSELSGINPYEARVKGLSQKLSEEE | 107 |
| S1 | 154 | TYLALAHNIKFRGHFLIEGDLNPDNSDVDKLFIQLVQTYNQLFEENPINASGVDAKAILSARLSKSRRLENLIAQLPGEK | 233 |
| S2 | 155 | VYLALAHMIKFRGHFLIEGELNAENTDVQKIFADFVGVYNRTFDDSHLSEITVDVASILTEKISKSRRLENLIKYYPTEK | 234 |
| S3 | 154 | TYLALAHNIKYRGHFLYEEAFDIKNNDIQKIFNEFISIYDNTFEGSSLSGQNAQVEAIFTDKISKSAKRERVLKLEPDEK | 233 |
| S4 | 108 | FSAALLHLAKRRG---------------------VHNVNEVEEDT--------------------------------- | 131 |
| S1 | 234 | KNGLFGNLIALSLGLTPNFKSNFDLAEDAKLQLSKDTYDDDLDNLLAQIGDQYADLFLAAKNLSDAILLSDILRVNTEIT | 313 |
| S2 | 235 | KNTLFGNLIALALGLQPNEKTNFKLSEDAKLQFSKDTYEEDLEELLGKIGDDYADLFTSAKNLYDAILLSGILTVDDNST | 314 |
| S3 | 234 | STGLFSEFLKLIVGNQADFKKHFDLEDKAPLQFSKDTYDEDLENLLGQIGDDFTDLFVSAKKLYDAILLSGILTVTDPST | 313 |
| S4 | 132 | -----GNELS-----------------TKEQISRN------------------------------------------ | 144 |
| S1 | 314 | KAPLSASMIKRYDEHHQDLTLLKALVRQQLPEKYKEIFFDQSKNGYAGYIDGGASQEEFYKFIKPILEKM--DGTEELLV | 391 |
| S2 | 315 | KAPLSASMIKRYVEHHEDLEKLKEFIKANKSELYHDIFKDKNKNGYAGYIENGVKQDEFYKYLKNILSKIKIDGSDYFLD | 394 |
| S3 | 314 | KAPLSASMIERYENHQNDLAALKQFIKNNLPEKYDEVFSDQSKDGYAGYIDGKTTQETFYKYIKNLLSKF--EGTDYFLD | 391 |
| S4 | 145 | ----SKALEEKYVAELQ-----------------------------------------------LERLKKDG------ | 165 |
| S1 | 392 | KLNREDLLRKQRTFDNGSIPHQIHLGELHAILRRQEDFYPFLKDNREKIEKILTFRIPYYVGPLARGNSRFAWMTRKSEE | 471 |
| S2 | 395 | KIEREDFLRKQRTFDNGSIPHQIHLQEMHAILRRQGDYYPFLKEKQDRIEKILTFRIPYYVGPLVRKDSRFAWAEYRSDE | 474 |
| S3 | 392 | KIEREDFLRKQRTFDNGSIPHQIHLQEMNAILRRQGEYYPFLKDRKEKIEKILTFRIPYYVGPLARGNRDFAWLTRNSDE | 471 |
| S4 | 166 | --EVRGSINRFKTSD--------YVKEAKQLLKVQKAYHQLDQSFIDTYIDLLETRRTYYEGP--GEGSPFGW------K | 227 |
| S1 | 472 | TITPWNFEEVVDKGASAQSFIERMTNFDKNLPNEKVLPKHSLLYEYFTVYNELTKVKYVTEGMRKPAFLSGEQKKAIVDL | 551 |
| S2 | 475 | KITPWNFDKVIDKEKSAEKFITRMTLNDLYLPEEKVLPKHSHVYETYAVYNELTKIKYVNEQGKE-SFFDSNMKQEIFDH | 553 |
| S3 | 472 | AIRPWNFEEIVDKASSAEDFINKMTNYDLYLPEEKVLPKHSLLYETFAVYNELTKVKFIAEGLRDYQFLDSGQKKQIVNQ | 551 |
| S4 | 228 | DIKEW---------------YEMLMGHCTYFPEELRSVKYAYNADLYNALNDLNNLVITRDENEK---LEYYEKFQIIEN | 289 |
| S1 | 552 | LEKTNRKVTVKQLKEDYFKKIECFDSVEISGVEDR---FNASLGTYHDLLKIIKDKDFLDNEENEDILEDIVLTLTLFED | 628 |
| S2 | 554 | VFKENRKVTKEKLLNYLNKEFFEYRIKDLIGLDKENKSFNASLGTYHDLKKIL-DKAFLDDKVNEEVIEDIIKTLTLFED | 632 |
| S3 | 552 | LEKENRKVTEKDIIHYLHN-VDGYDGIELKGIEKQ---FNASLSTYHDLLKIIKDKEENDDAKNEAILENIVHTLTIFED | 627 |
| S4 | 290 | VFKQKKKPTLKQIAKEILVNEEDIKGYRVTSTGKPEF---TNLKVYHDIKDITARKEII---ENAELLDQIAKILTIYQS | 363 |
| S1 | 629 | REMIEERLKTYAHLFDDKVMKQLKR-RRYTGWGRLSRKLINGIRDKQSGKTILDFLKSDGFANRNFMQLIHDDSLTFKED | 707 |
| S2 | 633 | KDMIHERLQKYSDIFTANQLKKLER-RHYTGWGRLSYKLINGIRNKENNKTILDYLIDDGSANRNFMQLINDDTLPFKQI | 711 |
| S3 | 628 | REMIKQRLAQYDSLFDEKVIKALTR-RHYTGWGKLSAKLINGICDKQTGNTILDYLIDDGKINRNFMQLINDDGLSFKEI | 706 |
| S4 | 364 | SEDIQEELTNLNSELTQEEIEQISNLKGYTGTHNLSLKAINLILDE------LWHTNDNQIAIFNRLKLVP--------- | 428 |
| S1 | 708 | IQKAQVSGQGDSLHEHIANLAGSPAIKKGILQTVKVVDELVKVMGRHKPENIVIEMARENQTT------QK**GQKNSRERM** | 781 |
| S2 | 712 | IQKSQVVGDVDDIEAVVHDLPGSPAIKKGILQSVKIVDELVKVMG-GNPDNIVIEMARENQTT------NR**GRSQSQQRL** | 784 |
| S3 | 707 | IQKAQVIGKTDDVKQVVQELSGSPAIKKGILQSIKIVDELVKVMG-HAPESIVIEMARENQTT------AR**GKKNSQQRY** | 779 |

-continued

```
S4   429  -KKVDLSQQKEIPTTLVDDFILSPVVKRSFIQSIKVINAIIKKYG--LPNDIIIELAREKNSKDAQKMINEMQKRNRQTN   505

S1   782  KRIEEGIKELGSQIL-------KEHPVENTQLQNEKLYLYYLQNGRDMYVDQELDINRLSD----YDVDH*IVPQSFLKDD  850

S2   785  KKLQNSLKELGSNILNEEKPSYIEDKVENSHLQNDQLFLYYIQNGKDMYTGDELDIDHLSD----YDIDH*IIPQAFIKDD  860

S3   780  KRIEDSLKILASGL---DSNILKENPTDNNQLQNDRLFLYYLQNGKDMYTGEALDINQLSS----YDIDH*IIPQAFIKDD  852

S4   506  ERIEEIIRTTGK---------------ENAKYLIEKIKLHDMQEGKCLYSLEAIPLEDLLNNPFNYEVDH*IIPRSVSFDN  570

S1   851  SIDNKVLTRSDKNRGKSDNVPSEEVVKKMKNYWRQLLNAKLITQRKFDN-LTKAERGGL-SELD------KAGFIKRQLV  922

S2   861  SIDNRVLTSSAKNRGKSDDVPSLDIVRARKAEWVRLYKSGLISKRKRDN-LTKAERGGL-TEAD------KAGFIKRQLV  932

S3   853  SLDNRVLTSSKDNRGKSDNVPSIEVVQKRKAFWQQLLDSKLISERKFNN-LTKAERGGL-DERD------KVGFIKRQLV  924

S4   571  SFNNKVLVKQEEASKKGNRTPFQYLSSSDSKISYETFKKHILNLAKGKGRISKTKKEYLLEERDINRFSVQKDFINRNLV  650

S1   923  ETRQITKHVAQILDSRMNTKYDENDKLIREVKVITLKSKLVSDFRKDFQFYKVREINNYHHAHDAYLNAVVGTALIKKYP  1002

S2   933  ETRQITKHVAQILDARFNTEHDENDKVIRDVKVITLKSNLVSQFRKDFEFYKVREINDYHHAHDAYLNAVVGTALLKKYP  1012

S3   925  ETRQITKHVAQILDARYNTEVNEKDKKNRTVKIITLKSNLVSNFRKEFRLYKVREINDYHHAHDAYLNAVVAKAILKKYP  1004

S4   651  DTRYATRGLMNLLRSYFRVN-------NLDVKVKSINGGFTSFLRRKWKFKKERNKGYKHHAEDALIIA-----------  712

S1  1003  KLESEFVYGDYKVYDVRKMIAKSEQ--EIGKATAKYFFYSNIMNFFKTEITLANGEIRKRPLIETNGETGEIVWDKG---  1077

S2  1013  KLASEFVYGEYKKYDIRKFITNSSD-----KATAKYFFYSNLMNFFKTKVKYADGTVFERPIIETNAD-GEIAWNKQ---  1083

S3  1005  KLEPEFVYGEYQKYDLKRYISRSKDPKEVEKATEKYFFYSNLLNFFKEEVHYADGTIVKRENIEYSKDTGEIAWNKE---  1081

S4   713  --NADFIFKEWKKLDKAKKVMENQM-------------------------FEEKQAESMPEIETEQEYKEIFITPHQIK  764

S1  1078  -----RDFATVRKVLSMPQVNIVKKTEVQTGGFSKESILPKRNSDKLIARKKD---WDPKKYGGFDSPTVAYSVLVVAKV  1149

S2  1084  -----IDFEKVRKVLSYPQVNIVKKVETQTGGFSKESILPKGDSDKLIPRKTKKVYWDTKKYGGFDSPTVAYSVFVVADV  1158

S3  1082  -----KDFAIIKKVLSLPQVNIVKKREVQTGGFSKESILPKGNSDKLIPRKTKDILLDTTKYGGFDSPVIAYSILLIADI  1156

S4   765  HIKDFKDYKYSHRVDKKPNRELINDTLYSTRKDDKGNTLIVNNLNGLYDKDNDKL----KKLIN-KSP----EKLLMYHH  835

S1  1150  EKGKSKKLKSVKELLGITIMERSSFEKNPI-DFLEAKG-----YKEVKKDLIIKLPKYSLFELENGRKRMLASAGELQKG  1223

S2  1159  EKGKAKKLKTVKELVGISIMERSFFEENPV-EFLENKG-----YHNIREDKLIKLPKYSLFEFEGGRRRLLASASELQKG  1232

S3  1157  EKGKAKKLKTVKTLVGITIMEKAAFEENPI-TFLENKG-----YHNVRKENILCLPKYSLFELENGRRRLLASAKELQKG  1230

S4   836  DPQTYQKLK--------LIMEQYGDEKNPLYKYYEETGNYLTKYSKKDNGPVIKKIKYYGNKLNAHLDITDDYPNSRNKV  907

S1  1224  NELALPSKYVNFLYLASHYEKLKGSPEDNEQKQLFVEQHKHYLDEITEQISEFSKRVILADANLDKVLSAYNKH------  1297

S2  1233  NEMVLPGYLVELLYHAHRADNF-----NSTEYLNYVSEHKKEFEKVLSCVEDFANLYVDVEKNLSKIRAVADSM------  1301

S3  1231  NEIVLPVYLTTLLYHSKNVHKL-----DEPGHLEYIQKHRNEFKDLLNLVSEFSQKYVLADANLEKIKSLYADN------  1299

S4   908  VKLSLKPYRFD-VYLDNGVYKFV-----TVKNLDVIK--KENYYEVNSKAYEEAKKLKKISNQAEFIASFYNNDLIKING  979

S1  1298  RDKPIREQAENITHLFTLTNLGAPAAFKYFDTTIDRKRYTSTKEVLDATLIHQSIT--------GLYETRI----DLSQL  1365

S2  1302  DNFSIEEISNSFINLLTLTALGAPADFNFLGEKIPRKRYTSTKECLNATLIHQSIT--------GLYETRI----DLSKL  1369

S3  1300  EQADIEILANSFINLLTFTALGAPAAFKFFGKDIDRKRYTTVSEILNATLIHQSIT--------GLYETWI----DLSKL  1367

S4   980  ELYRVIGVNNDLLNRIEVNMIDITYR-EYLENMNDKRPPRIIKTIASKT---QSIKKYSTDILGNLYEVKSKKHPQIIKK  1055
```

-continued

```
S1  1366 GGD 1368 (SEQ ID NO: 23)

S2  1370 GEE 1372 (SEQ ID NO: 24)

S3  1368 GED 1370 (SEQ ID NO: 25)

S4  1056 G-- 1056 (SEQ ID NO: 26)
```

The alignment demonstrates that amino acid sequences and amino acid residues that are homologous to a reference Cas9 amino acid sequence or amino acid residue can be identified across Cas9 sequence variants, including, but not limited to Cas9 sequences from different species, by identifying the amino acid sequence or residue that aligns with the reference sequence or the reference residue using alignment programs and algorithms known in the art. This disclosure provides Cas9 variants in which one or more of the amino acid residues identified by an asterisk in SEQ ID NOs: 23-26 (e.g., S1, S2, S3, and S4, respectively) are mutated as described herein. The residues D10 and H840 in Cas9 of SEQ ID NO: 6 that correspond to the residues identified in SEQ ID NOs: 23-26 by an asterisk are referred to herein as "homologous" or "corresponding" residues. Such homologous residues can be identified by sequence alignment, e.g., as described above, and by identifying the sequence or residue that aligns with the reference sequence or residue. Similarly, mutations in Cas9 sequences that correspond to mutations identified in SEQ ID NO: 6 herein, e.g., mutations of residues 10, and 840 in SEQ ID NO: 6, are referred to herein as "homologous" or "corresponding" mutations. For example, the mutations corresponding to the D10A mutation in SEQ ID NO: 6 or 51 (SEQ ID NO: 23) for the four aligned sequences above are D11A for S2, D10A for S3, and D13A for S4; the corresponding mutations for H840A in SEQ ID NO: 6 or 51 (SEQ ID NO: 23) are H850A for S2, H842A for S3, and H560A for S4.

Further, several Cas9 sequences from different species have been aligned using the same algorithm and alignment parameters outlined above. Several Cas9 sequences (SEQ ID NOs: 11-260 of the '632 publication) from different species were aligned using the same algorithm and alignment parameters outlined above, and is shown in .e.g., Patent Publication No. WO2017/070632 ("the '632 publication"), published Apr. 27, 2017, entitled "Nucleobase editors and uses thereof"; which is incorporated by reference herein. Amino acid residues homologous to residues of other Cas9 proteins may be identified using this method, which may be used to incorporate corresponding mutations into other Cas9 proteins. Amino acid residues homologous to residues 10, and 840 of SEQ ID NO: 6 were identified in the same manner as outlined above. The alignments are provided herein and are incorporated by reference. The HNH domain (bold and underlined) and the RuvC domain (boxed) are identified for each of the four sequences (SEQ ID NOs: 23-26). Single residues corresponding to amino acid residues 10, and 840 in SEQ ID NO: 6 are boxed in SEQ ID NO: 23 in the alignments, allowing for the identification of the corresponding amino acid residues in the aligned sequences.

EQUIVALENTS AND SCOPE, INCORPORATION BY REFERENCE

Those skilled in the art will recognize, or be able to ascertain using no more than routine experimentation, many equivalents to the specific embodiments of the invention described herein. The scope of the present invention is not intended to be limited to the above description, but rather is as set forth in the appended claims.

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention also includes embodiments in which more than one, or all of the group members are present in, employed in, or otherwise relevant to a given product or process.

Furthermore, it is to be understood that the invention encompasses all variations, combinations, and permutations in which one or more limitations, elements, clauses, descriptive terms, etc., from one or more of the claims or from relevant portions of the description is introduced into another claim. For example, any claim that is dependent on another claim can be modified to include one or more limitations found in any other claim that is dependent on the same base claim. Furthermore, where the claims recite a composition, it is to be understood that methods of using the composition for any of the purposes disclosed herein are included, and methods of making the composition according to any of the methods of making disclosed herein or other methods known in the art are included, unless otherwise indicated or unless it would be evident to one of ordinary skill in the art that a contradiction or inconsistency would arise.

Where elements are presented as lists, e.g., in Markush group format, it is to be understood that each subgroup of the elements is also disclosed, and any element(s) can be removed from the group. It is also noted that the term "comprising" is intended to be open and permits the inclusion of additional elements or steps. It should be understood that, in general, where the invention, or aspects of the invention, is/are referred to as comprising particular elements, features, steps, etc., certain embodiments of the invention or aspects of the invention consist, or consist essentially of, such elements, features, steps, etc. For purposes of simplicity those embodiments have not been specifically set forth in haec verba herein. Thus for each embodiment of the invention that comprises one or more elements, features, steps, etc., the invention also provides embodiments that consist or consist essentially of those elements, features, steps, etc.

Where ranges are given, endpoints are included. Furthermore, it is to be understood that unless otherwise indicated or otherwise evident from the context and/or the understanding of one of ordinary skill in the art, values that are expressed as ranges can assume any specific value within the stated ranges in different embodiments of the invention, to the tenth of the unit of the lower limit of the range, unless the context clearly dictates otherwise. It is also to be understood that unless otherwise indicated or otherwise evident from the context and/or the understanding of one of ordinary skill in the art, values expressed as ranges can assume any subrange within the given range, wherein the endpoints of the subrange are expressed to the same degree of accuracy as the tenth of the unit of the lower limit of the range.

In addition, it is to be understood that any particular embodiment of the present invention may be explicitly excluded from any one or more of the claims. Where ranges are given, any value within the range may explicitly be excluded from any one or more of the claims. Any embodiment, element, feature, application, or aspect of the compositions and/or methods of the invention, can be excluded from any one or more claims. For purposes of brevity, all of the embodiments in which one or more elements, features, purposes, or aspects is excluded are not set forth explicitly herein.

All publications, patents and sequence database entries mentioned herein, including those items listed above, are hereby incorporated by reference in their entirety as if each individual publication or patent was specifically and individually indicated to be incorporated by reference. In case of conflict, the present application, including any definitions herein, will control.

SEQUENCE LISTING (123 sequences)

SEQ ID NO: 1 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 2 - DNA, 4212 bp, Artificial Sequence
  Synthetic polynucleotide
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 3 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 4 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 5 - protein, 1368 aa, Artificial Sequence
  Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 6 - protein, 1368 aa, Streptococcus pyogenes [sequence omitted]

SEQ ID NO: 7 - protein, 1368 aa, Artificial Sequence
  Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 8 - protein, 1367 aa, Artificial Sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 9 - protein, 1368 aa, Artificial Sequence; identical to SEQ ID NO: 7
  Synthetic polypeptide

SEQ ID NO: 10 - protein, 1367 aa, Artificial Sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 11 - protein, 1367 aa, Artificial Sequence
  Synthetic polypeptide
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 12 - protein, 1052 aa, Artificial Sequence
  Synthetic polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 13 - protein, 1052 aa, Artificial Sequence
  Synthetic polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 14 - protein, 1052 aa, Artificial Sequence
  Synthetic polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 15 - protein, 1367 aa, Artificial Sequence; identical to SEQ ID NO: 11
  Synthetic polypeptide

SEQ ID NO: 16 - protein, 1367 aa, Artificial Sequence; identical to SEQ ID NO: 10
  Synthetic polypeptide

SEQ ID NO: 17 - protein, 1367 aa, Artificial Sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 18 - protein, 1367 aa, Artificial Sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 19 - protein, 1367 aa, Artificial Sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 20 - protein, 1367 aa, Artificial Sequence
  Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 21 - protein, 1368 aa, Artificial Sequence; identical to SEQ ID NO: 5
  Synthetic polypeptide

SEQ ID NO: 22 - protein, 1368 aa, Artificial Sequence; identical to SEQ ID NO: 7
  Synthetic polypeptide

SEQ ID NO: 23 - protein, 1368 aa, Streptococcus pyogenes [sequence omitted]

SEQ ID NO: 24 - protein, 1372 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFANEIAKVDESFFQRLDESFLTDDDKTFDSHPIFGNKAEEDAYHQKFPTIYHLRKHLADSSEKADLRLVYLALAHMIKFRGHFLIEGELNAENTDVQKIFADFVGVYNRTFDDSHLSEITVDVASILTEKISKSRRLENLIKYYPTEKKNTLFGNLIALALGLQPNFKTNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNILSKIKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGGNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKLGEE

SEQ ID NO: 25 - protein, 1370 aa, Streptococcus gordonii
MKKGYSIGLDIGTNSVGFAVITDDYKVPSKKMKVLGNTDKRFIKKNLIGALLFDEGTTAEARRLKRTARRRYTRRKNRLRYLQEIFSEEMSKVDSSFFHRLDDSFLIPEDKRESKYPIFATLTEEKEYHKQFPTIYHLRKQLADSKEKTDLRLIYLALAHMIKYRGHFLYEEAFDIKNNDIQKIFNEFISIYDNTFEGSSLSGQNAQVEAIFTDKISKSAKRERVLKLFPDEKSTGLFSEFLKLIVGNQADFKKHFDLEDKAPLQFSKDTYDEDLENLLGQIGDDFTDLFVSAKKLYDAILLSGILTVTDPSTKAPLSASMIERYENHQNDLAALKQFIKNNLPEKYDEVFSDQSKDGYAGYIDGKTTQETFYKYIKNLLSKFEGTDYFLDKIEREDFLRKQRTFDNGSIPHQIHLQEMNAILRRQGEYYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVNQLFKENRKVTEKDIIHYLHNVDGYDGIELKGIEKQFNASLSTYHDLLKIIKDKEFMDDAKNEAILENIVHTLTIFEDREMIKQRLAQYDSLFDEKVIKALTRRHYTGWGKLSAKLINGICDKQTGNTILDYLIDDGKINRNFMQLINDDGLSFKEIIQKAQVIGKTDDVKQVVQELSGSPAIKKGILQSIKIVDELVKVMGHAPESIVIEMARENQTTARGKKNSQQRYKRIEDSLKILASGLDSNILKENPTDNNQLQNDRLFLYYLQNGKDMYTGEALDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARYNTEVNEKDKKNRTVKIITLKSNLVSNFRKEFRLYKVREINDYHHAHDAYLNAVVAKAILKKYPKLEPEFVYGEYQKYDLKRYISRSKDPKEVEKATEKYFFYSNLLNFFKEEVHYADGTIVKRENIEYSKDTGEIAWNKEKDFAIIKKVLSLPQVNIVKKREVQTGGFSKESILPKGNSDKLIPRKTKDILLDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPGHLEYIQKHRNEFKDLLNLVSEFSQKYVLADANLEKIKSLYADNEQADIEILANSFINLLTFTALGAPAAFKFFGKDIDRKRYTTVSEILNATLIHQSITGLYETWIDLSKLGED

SEQ ID NO: 26 - protein, 1056 aa, Staphylococcus aureus
GSHMKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKAYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 27 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 28 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 29 - protein, 1210 aa, Unknown
  uncultured Parcubacteria group bacterium
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 30 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 31 - protein, 1300 aa, Artificial Sequence
  Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 32 - protein, 1300 aa, Artificial Sequence
  Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 33 - protein, 1300 aa, Artificial Sequence
  Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 34 - protein, 1300 aa, Artificial Sequence
  Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 35 - protein, 1300 aa, Artificial Sequence
  Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 36 - protein, 1300 aa, Artificial Sequence
  Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 37 - protein, 1300 aa, Artificial Sequence
  Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 38 - protein, 887 aa, Natronobacterium gregoryi
MTVIDLDSTTTADELTSGHTYDISVTLTGVYDNTDEQHPRMSLAFEQDNGERRYITLWKNTTPKDVFTYDYATGSTYIFTNIDYEVKDGYENLTATYQTTVENATAQEVGTTDEDETFAGGEPLDHHLDDALNETPDDAETESDSGHVMTSFASRDQLPEWTLHTYTLTATDGAKTDTEYARRTLAYTVRQELYTDHDAAPVATDGLMLLTPEPLGETPLDLDCGVRVEADETRTLDYTTAKDRLLARELVEEGLKRSLWDDYLVRGIDEVLSKEPVLTCDEFDLHERYDLSVEVGHSGRAYLHINFRHRFVPKLTLADIDDDNIYPGLRVKTTYRPRRGHIVWGLRDECATDSLNTLGNQSVVAYHRNNQTPINTDLLDAIEAADRRVVETRRQGHGDDAVSFPQELLAVEPNTHQIKQFASDGFHQQARSKTRLSASRCSEKAQAFAERLDPVRLNGSTVEFSSEFFTGNNEQQLRLLYENGESVLTFRDGARGAHPDETFSKGIVNPPESFEVAVVLPEQQADTCKAQWDTMADLLNQAGAPPTRSETVQYDAFSSPESISLNVAGAIDPSEVDAAFVVLPPDQEGFADLASPTETYDELKKALANMGIYSQMAYFDRFRDAKIFYTRNVALGLLAAAGGVAFTTEHAMPGDADMFIGIDVSRSYPEDGASGQINIAATATAVYKDGTILGHSSTRPQLGEKLQSTDVRDIMKNAILGYQQVTGESPTHIVIHRDGFMNEDLDPATEFLNEQGVEYDIVEIRKQPQTRLLAVSDVQYDTPVKSIAAINQNEPRATVATFGAPEYLATRDGGGLPRPIQIERVAGETDIETLTRQVYLLSQSHIQVHNSTARLPITTAYADQASTHATKGYLVQTGAFESNVGFL

SEQ ID NO: 39 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 40 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 41 - protein, 7 aa, Artificial Sequence
  Synthetic polypeptide
PKKKRKV

SEQ ID NO: 42 - protein, 30 aa, Artificial Sequence
  Synthetic polypeptide
MDSLLMNRRKFLYQFKNVRWAKGRRETYLC

SEQ ID NO: 43 - protein, 18 aa, Artificial Sequence
  Synthetic polypeptide
KRTADGSEFESPKKKRKV

SEQ ID NO: 44 - protein, 19 aa, Artificial Sequence
  Synthetic polypeptide
KRGINDRNFWRGENGRKTR

SEQ ID NO: 45 - protein, 17 aa, Artificial Sequence
  Synthetic polypeptide
KKTGGPIYRRVDGKWRR

SEQ ID NO: 46 - protein, 17 aa, Artificial Sequence
  Synthetic polypeptide
RRELILYDKEEIRRIWR

SEQ ID NO: 47 - protein, 8 aa, Artificial Sequence
  Synthetic polypeptide
AVSRKRKA

SEQ ID NO: 48 - protein, 313 aa, Artificial Sequence
  Synthetic polypeptide
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 49 - protein, 209 aa, Artificial Sequence
  Synthetic polypeptide
MAGAQDFVPHTADLAELAAAAGECRGCGLYRDATQAVFGAGGRSARIMMIGEQPGDKEDLAGLPFVGPAGRLLDRALEAADIDRDALYVTNAVKHFKFTRAAGGKRRIHKTPSRTEVVACRPWLIAEMTSVEPDVVVLLGATAAKALLGNDFRVTQHRGEVLHVDDVPGDPALVATVHPSSLLRGPKEERESAFAGLVDDLRVAADVRP

SEQ ID NO: 50 - protein, 209 aa, Artificial Sequence
  Synthetic polypeptide
MAGAQDFVPHTADLAELAAAAGECRGCGLYRDATQAVFGAGGRSARIMMIGEQPGDKEDLAGLPFVGPAGRLLDRALEAADIDRDALYVTNAVKHFKFTRAAGGKRSIHKTPSRTEVVACRPWLIAEMTSVEPDVVVLLGATAAKALLGNDFRVTQHRGEVLHVDDVPGDPALVATVHPSSLLRGPKEERESAFAGLVDDLRVAADVRP

SEQ ID NO: 51 - protein, 209 aa, Artificial Sequence
  Synthetic polypeptide
MAGAQDFVPHTADLAELAAAAGECRGCGLYRDATQAVFGAGGRSARIMMIGEQPGDKEDLAGLPFVGPAGRLLDRALEAADIDRDALYVTNAVKHFKFTRAAGGKRRISKTPSRTEVVACRPWLIAEMTSVEPDVVVLLGATAAKALLGNDFRVTQHRGEVLHVDDVPGDPALVATVHPSSLLRGPKEERESAFAGLVDDLRVAADVRP

SEQ ID NO: 52 - protein, 211 aa, Artificial Sequence
  Synthetic polypeptide
MTTLTRQDLNFGQVVADVLCEFLEVAVHLILYVREVYPVGIFQKRKKYNVPVQMSCHPELNQYIQDTLHCVKPLLEKNDVEKVVVVILDKEHRPVEKFVFEITQPPLLSISSDSLLSHVEQLLRAFILKISVCDAVLDHNPPGCTFTVLVHTREAATRNMEKIQVIKDFPWILADEQDVHMHDPRLIPLKTMTSDILKMQLYVEERAHKGS

SEQ ID NO: 53 - protein, 270 aa, Artificial Sequence
  Synthetic polypeptide
MPQAFLLGSIHEPAGALMEPQPCPGSLAESFLEEELRLNAELSQLQFSEPVGIIYNPVEYAWEPHRNYVTRYCQGPKEVLFLGMNPGPFGMAQTGVPFGEVSMVRDWLGIVGPVLTPPQEHPKRPVLGLECPQSEVSGARFWGFFRNLCGQPEVFFHHCFVHNLCPLLFLAPSGRNLTPAELPAKQREQLLGICDAALCRQVQLLGVRLVVGVGRLAEQRARRALAGLMPEVQVEGLLHPSPRNPQANKGWEAVAKERLNELGLLPLLLK

SEQ ID NO: 54 - protein, 335 aa, Artificial Sequence
  Synthetic polypeptide
MSKRKAPQETLNGGITDMLTELANFEKNVSQAIHKYNAYRKAASVIAKYPHKIKSGAEAKKLPGVGTKIAEKIDEFLATGKLRKLEKIRQDDTSSSINFLTRVSGIGPSAARKFVDEGIKTLEDLRKNEDKLNHHQRIGLKYFGDFEKRIPREEMLQMQDIVLNEVKKVDSEYIATVCGSFRRGAESSGDMDVLLTHPSFTSESTKQPKLLHQVVEQLQKVHFITDTLSKGETKFMGVCQLPSKNDEKEYPHRRIDIRLIPKDQYYCGVLYFTGSDIFNKNMRAHALEKGFTINEYTIRPLGVTGVAGEPLPVDSEKDIFDYIQWKYREPKDRSE

SEQ ID NO: 55 - protein, 575 aa, Artificial Sequence
  Synthetic polypeptide
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPGAQLVKSAWLSLCLQERRLVDVAGFSIFIPSRYLDHPQPSKAEQDASIPPGTHEALLQTALSPPPPPTRPVSPPQKAKEAPNTQAQPISDDEASDGEETQVSAADLEALISGHYPTSLEGDCEPSPAPAVLDKWVCAQPSSQKATNHNLHITEKLEVLAKAYSVQGDKWRALGYAKAINALKSFHKPVTSYQEACSIPGIGKRMAEKIIEILESGHLRKLDHISESVPVLELFSNIWGAGTKTAQMWYQQGFRSLEDIRSQASLTTQQAIGLKHYSDFLERMPREEATEIEQTVQKAAQAFNSGLLCVACGSYRRGKATCGDVDVLITHPDGRSHRGIFSRLLDSLRQEGFLTDDLVSQEENGQQQKYLGVCRLPGPGRRHRRLDIIVVPYSEFACALLYFTGSAHFNRSMRALAKTKGMSLSEHALSTAVVRNTHGCKVGPGRVLPTPTEKDVFRLLGLPYREPAERDW

SEQ ID NO: 56 - protein, 713 aa, Artificial Sequence
  Synthetic polypeptide
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 57 - protein, 494 aa, Artificial Sequence
  Synthetic polypeptide
MLPKRRRARVGSPSGDAASSTPPSTRFPGVAIYLVEPRMGRSRRAFLTGLARSKGFRVLDACSSEATHVVMEETSAEEAVSWQERRMAAAPPGCTPPALLDISWLTESLGAGQPVPVECRHRLEVAGPRKGPLSPAWMPAYACQRPTPLTHHNTGLSEALEILAEAAGFEGSEGRLLTFCRAASVLKALPSPVTTLSQLQGLPHFGEHSSRVVQELLEHGVCEEVERVRRSERYQTMKLFTQIFGVGVKTADRWYREGLRTLDDLREQPQKLTQQQKAGLQHHQDLSTPVLRSDVDALQQVVEEAVGQALPGATVTLTGGFRRGKLQGHDVDFLITHPKEGQEAGLLPRVMCRLQDQGLILYHQHQHSCCESPTRLAQQSHMDAFERSFCIFRLPQPPGAAVGGSTRPCPSWKAVRVDLVVAPVSQFPFALLGWTGSKLFQRELRRFSRKEKGLWLNSHGLFDPEQKTFFQAASEEDIFRHLGLEYLPPEQRNA

SEQ ID NO: 58 - protein, 740 aa, Artificial Sequence
  Synthetic polypeptide
MEKLGVEPEEEGGGDDDEEDAEAWAMELADVGAAASSQGVHDQVLPTPNASSRVIVHVDLDCFYAQVEMISNPELKDKPLGVQQKYLVVTCNYEARKLGVKKLMNVRDAKEKCPQLVLVNGEDLTRYREMSYKVTELLEEFSPVVERLGFDENFVDLTEMVEKRLQQLQSDELSAVTVSGHVYNNQSINLLDVLHIRLLVGSQIAAEMREAMYNQLGLTGCAGVASNKLLAKLVSGVFKPNQQTVLLPESCQHLIHSLNHIKEIPGIGYKTAKCLEALGINSVRDLQTFSPKILEKELGISVAQRIQKLSFGEDNSPVILSGPPQSFSEEDSFKKCSSEVEAKNKIEELLASLLNRVCQDGRKPHTVRLIIRRYSSEKHYGRESRQCPIPSHVIQKLGTGNYDVMTPMVDILMKLFRNMVNVKMPFHLTLLSVCFCNLKALNTAKKGLIDYYLMPSLSTTSRSGKHSFKMKDTHMEDFPKDKETNRDFLPSGRIESTRTRESPLDTTNFSKEKDINEFPLCSLPEGVDQEVFKQLPVDIQEEILSGKSREKFQGKGSVSCPLHASRGVLSFFSKKQMQDIPINPRDHLSSSKQVSSVSPCEPGTSGFNSSSSSYMSSQKDYSYYLDNRLKDERISQGPKEPQGFHFTNSNPAVSAFHSFPNLQSEQLFSRNHTTDSHKQTVATDSHEGLTENREPDSVDEKITFPSDIDPQVFYELPEAVQKELLAEWKRAGSDFHIGHK

SEQ ID NO: 59 - protein, 870 aa, Artificial Sequence
  Synthetic polypeptide
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKGRTVTIKLKNVNFEVKTRASTVSSVVSTAEEIFAIAKELLKTEIDADFPHPLRLRLMGVRISSFPNEEDRKHQQRSIIGFLQAGNQALSATECTLEKTDKDKFVKPLEMSHKKSFFDKKRSERKWSHQDTFKCEAVNKQSFQTSQPFQVLKKKMNENLEISENSDDCQILTCPVCFRAQGCISLEALNKHVDECLDGPSISENFKMFSCSHVSATKVNKKENVPASSLCEKQDYEAHPKIKEISSVDCIALVDTIDNSSKAESIDALSNKHSKEECSSLPSKSFNIEHCHQNSSSTVSLENEDVGSFRQEYRQPYLCEVKTGQALVCPVCNVEQKTSDLTLFNVHVDVCLNKSFIQELRKDKFNPVNQPKESSRSTGSSSGVQKAVTRTKRPGLMTKYSTSKKIKPNNPKHTLDIFFK

SEQ ID NO: 60 - protein, 1468 aa, Artificial Sequence
  Synthetic polypeptide
MAPVHGDDCEIGASALSDSGSFVSSRARREKKSKKGRQEALERLKKAKAGEKYKYEVEDFTGVYEEVDEEQYSKLVQARQDDDWIVDDDGIGYVEDGREIFDDDLEDDALDADEKGKDGKARNKDKRNVKKLAVTKPNNIKSMFIACAGKKTADKAVDLSKDGLLGDILQDLNTETPQITPPPVMILKKKRSIGASPNPFSVHTATAVPSGKIASPVSRKEPPLTPVPLKRAEFAGDDVQVESTEEEQESGAMEFEDGDFDEPMEVEEVDLEPMAAKAWDKESEPAEEVKQEADSGKGTVSYLGSFLPDVSCWDIDQEGDSSFSVQEVQVDSSHLPLVKGADEEQVFHFYWLDAYEDQYNQPGVVFLFGKVWIESAETHVSCCVMVKNIERTLYFLPREMKIDLNTGKETGTPISMKDVYEEFDEKIATKYKIMKFKSKPVEKNYAFEIPDVPEKSEYLEVKYSAEMPQLPQDLKGETFSHVFGTNTSSLELFLMNRKIKGPCWLEVKSPQLLNQPVSWCKVEAMALKPDLVNVIKDVSPPPLVVMAFSMKTMQNAKNHQNEIIAMAALVHHSFALDKAAPKPPFQSHFCVVSKPKDCIFPYAFKEVIEKKNVKVEVAATERTLLGFFLAKVHKIDPDIIVGHNIYGFELEVLLQRINVCKAPHWSKIGRLKRSNMPKLGGRSGFGERNATCGRMICDVEISAKELIRCKSYHLSELVQQILKTERVVIPMENIQNMYSESSQLLYLLEHTWKDAKFILQIMCELNVLPLALQITNIAGNIMSRTLMGGRSERNEFLLLHAFYENNYIVPDKQIFRKPQQKLGDEDEEIDGDTNKYKKGRKKAAYAGGLVLDPKVGFYDKFILLLDFNSLYPSIIQEFNICFTTVQRVASEAQKVTEDGEQEQIPELPDPSLEMGILPREIRKLVERRKQVKQLMKQQDLNPDLILQYDIRQKALKLTANSMYGCLGFSYSRFYAKPLAALVTYKGREILMHTKEMVQKMNLEVIYGDTDSIMINTNSTNLEEVFKLGNKVKSEVNKLYKLLEIDIDGVFKSLLLLKKKKYAALVVEPTSDGNYVTKQELKGLDIVRRDWCDLAKDTGNFVIGQILSDQSRDTIVENIQKRLIEIGENVLNGSVPVSQFEINKALTKDPQDYPDKKSLPHVHVALWINSQGGRKVKAGDTVSYVICQDGSNLTASQRAYAPEQLQKQDNLTIDTQYYLAQQIHPVVARICEPIDGIDAVLIATWLGLDPTQFRVHHYHKDEENDALLGGPAQLTDEEKYRDCERFKCPCPTCGTENIYDNVFDGSGTDMEPSLYRCSNIDCKASPLTFTVQLSNKLIMDIRRFIKKYYDGWLICEEPTCRNRTRHLPLQFSRTGPLCPACMKATLQPEYSDKSLYTQLCFYRYIFDAECALEKLTTDHEKDKLKKQFFTPKVLQDYRKLKNTAEQFLSRSGYSEVNLSKLFAGCAVKS

SEQ ID NO: 61 - protein, 1107 aa, Artificial Sequence [sequence omitted]

SEQ ID NO: 62 - protein, 1239 aa, Artificial Sequence
  Synthetic polypeptide
MSRLLWRKVAGATVGPGPVPAPGRWVSSSVPASDPSDGQRRRQQQQQQQQQQQQQPQQPQVLSSEGGQLRHNPLDIQMLSRGLHEQIFGQGGEMPGEAAVRRSVEHLQKHGLWGQPAVPLPDVELRLPPLYGDNLDQHFRLLAQKQSLPYLEAANLLLQAQLPPKPPAWAWAEGWTRYGPEGEAVPVAIPEERALVFDVEVCLAEGTCPTLAVAISPSAWYSWCSQRLVEERYSWTSQLSPADLIPLEVPTGASSPTQRDWQEQLVVGHNVSFDRAHIREQYLIQGSRMRFLDTMSMHMAISGLSSFQRSLWIAAKQGKHKVQPPTKQGQKSQRKARRGPAISSWDWLDISSVNSLAEVHRLYVGGPPLEKEPRELFVKGTMKDIRENFQDLMQYCAQDVWATHEVFQQQLPLFLERCPHPVTLAGMLEMGVSYLPVNQNWERYLAEAQGTYEELQREMKKSLMDLANDACQLLSGERYKEDPWLWDLEWDLQEFKQKKAKKVKKEPATASKLPIEGAGAPGDPMDQEDLGPCSEEEEFQQDVMARACLQKLKGTTELLPKRPQHLPGHPGWYRKLCPRLDDPAWTPGPSLLSLQMRVTPKLMALTWDGFPLHYSERHGWGYLVPGRRDNLAKLPTGTTLESAGVVCPYRAIESLYRKHCLEQGKQQLMPQEAGLAEEFLLTDNSAIWQTVEELDYLEVEAEAKMENLRAAVPGQPLALTARGGPKDTQPSYHHGNGPYNDVDIPGCWFFKLPHKDGNSCNVGSPFAKDFLPKMEDGTLQAGPGGASGPRALEINKMISFWRNAHKRISSQMVVWLPRSALPRAVIRHPDYDEEGLYGAILPQVVTAGTITRRAVEPTWLTASNARPDRVGSELKAMVQAPPGYTLVGADVDSQELWIAAVLGDAHFAGMHGCTAFGWMTLQGRKSRGTDLHSKTATTVGISREHAKIFNYGRIYGAGQPFAERLLMQFNHRLTQQEAAEKAQQMYAATKGLRWYRLSDEGEWLVRELNLPVDRTEGGWISLQDLRKVQRETARKSQWKKWEVVAERAWKGGTESEMFNKLESIATSDIPRTPVLGCCISRALEPSAVQEEFMTSRVNWVVQSSAVDYLHLMLVAMKWLFEEFAIDGRFCISIHDEVRYLVREEDRYRAALALQITNLLTRCMFAYKLGLNDLPQSVAFFSAVDIDRCLRKEVTMDCKTPSNPTGMERRYGIPQGEALDIYQIIELTKGSLEKRSQPGP

SEQ ID NO: 63 - protein, 900 aa, Artificial Sequence
  Synthetic polypeptide
MENYEALVGFDLCNTPLSSVAQKIMSAMHSGDLVDSKTWGKSTETMEVINKSSVKYSVQLEDRKTQSPEKKDLKSLRSQTSRGSAKLSPQSFSVRLTDQLSADQKQKSISSLTLSSCLIPQYNQEASVLQKKGHKRKHFLMENINNENKGSINLKRKHITYNNLSEKTSKQMALEEDTDDAEGYLNSGNSGALKKHFCDIRHLDDWAKSQLIEMLKQAAALVITVMYTDGSTQLGADQTPVSSVRGIVVLVKRQAEGGHGCPDAPACGPVLEGFVSDDPCIYIQIEHSAIWDQEQEAHQQFARNVLFQTMKCKCPVICFNAKDFVRIVLQFFGNDGSWKHVADFIGLDPRIAAWLIDPSDATPSFEDLVEKYCEKSITVKVNSTYGNSSRNIVNQNVRENLKTLYRLTMDLCSKLKDYGLWQLFRTLELPLIPILAVMESHAIQVNKEEMEKTSALLGARLKELEQEAHFVAGERFLITSNNQLREILFGKLKLHLLSQRNSLPRTGLQKYPSTSEAVLNALRDLHPLPKIILEYRQVHKIKSTFVDGLLACMKKGSISSTWNQTGTVTGRLSAKHPNIQGISKHPIQITTPKNFKGKEDKILTISPRAMFVSSKGHTFLAADFSQIELRILTHLSGDPELLKLFQESERDDVFSTLTSQWKDVPVEQVTHADREQTKKVVYAVVYGAGKERLAACLGVPIQEAAQFLESFLQKYKKIKDFARAAIAQCHQTGCVVSIMGRRRPLPRIHAHDQQLRAQAERQAVNFVVQGSAADLCKLAMIHVFTAVAASHTLTARLVAQIHDELLFEVEDPQIPECAALVRRTMESLEQVQALELQLQVPLKVSLSAGRSWGHLVPLQEAWGPPPGPCRTESPSNSLAAPGSPASTQPPPLHFSPSFCL

SEQ ID NO: 64 - protein, 1251 aa, Artificial Sequence
  Synthetic polypeptide
MRRGGWRKRAENDGWETWGGYMAAKVQKLEEQFRSDAAMQKDGTSSTIFSGVAIYVNGYTDPSAEELRKLMMLHGGQYHVYYSRSKTTHIIATNLPNAKIKELKGEKVIRPEWIVESIKAGRLLSYIPYQLYTKQSSVQKGLSFNPVCRPEDPLPGPSNIAKQLNNRVNHIVKKIETENEVKVNGMNSWNEEDENNDFSFVDLEQTSPGRKQNGIPHPRGSTAIFNGHTPSSNGALKTQDCLVPMVNSVASRLSPAFSQEEDKAEKSSTDFRDCTLQQLQQSTRNTDALRNPHRTNSFSLSPLHSNTKINGAHHSTVQGPSSTKSTSSVSTFSKAAPSVPSKPSDCNFISNFYSHSRLHHISMWKCELTEFVNTLQRQSNGIFPGREKLKKMKTGRSALVVTDTGDMSVLNSPRHQSCIMHVDMDCFFVSVGIRNRPDLKGKPVAVTSNRGTGRAPLRPGANPQLEWQYYQNKILKGKAADIPDSSLWENPDSAQANGIDSVLSRAEIASCSYEARQLGIKNGMFFGHAKQLCPNLQAVPYDFHAYKEVAQTLYETLASYTHNIEAVSCDEALVDITEILAETKLTPDEFANAVRMEIKDQTKCAASVGIGSNILLARMATRKAKPDGQYHLKPEEVDDFIRGQLVTNLPGVGHSMESKLASLGIKTCGDLQYMTMAKLQKEFGPKTGQMLYRFCRGLDDRPVRTEKERKSVSAEINYGIRFTQPKEAEAFLLSLSEEIQRRLEATGMKGKRLTLKIMVRKPGAPVETAKFGGHGICDNIARTVTLDQATDNAKIIGKAMLNMFHTMKLNISDMRGVGIHVNQLVPTNLNPSTCPSRPSVQSSHFPSGSYSVRDVFQVQKAKKSTEEEHKEVFRAAVDLEISSASRTCTFLPPFPAHLPTSPDTNKAESSGKWNGLHTPVSVQSRLNLSIEVPSPSQLDQSVLEALPPDLREQVEQVCAVQQAESHGDKKKEPVNGCNTGILPQPVGTVLLQIPEPQESNSDAGINLIALPAFSQVDPEVFAALPAELQRELKAAYDQRQRQGENSTHQQSASASVPKNPLLHLKAAVKEKKRNKKKKTIGSPKRIQSPLNNKLLNSPAKTLPGACGSPQKLIDGFLKHEGPPAEKPLEELSASTSGVPGLSSLQSDPAGCVRPPAPNLAGAVEFNDVKTLLREWITTISDPMEEDILQVVKYCTDLIEEKDLEKLDLVIKYMKRLMQQSVESVWNMAFDFILDNVQVVLQQTYGSTLKVT

SEQ ID NO: 65 - protein, 313 aa, Artificial Sequence
  Synthetic polypeptide
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPAHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 66 - protein, 313 aa, Artificial Sequence
  Synthetic polypeptide
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQDPYHGPNQAHGLCFSVQRPVPPPPSLENIYKELSTDIEDFVHPGHGDLSGWAKQGVLLLDAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 67 - protein, 198 aa, Homo sapiens [sequence omitted]

SEQ ID NO: 68 - protein, 198 aa, Mus musculus
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 69 - protein, 197 aa, Canis lupus familiaris
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLG

SEQ ID NO: 70 - protein, 198 aa, Bos taurus
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLG

SEQ ID NO: 71 - protein, 238 aa, Rattus norvegicus
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLTGWGALPAGLMSPARPSDYFYCWNTFVENHERTFKAWEGLHENSVRLSRRLRRILLPLYEVDDLRDAFRTLG

SEQ ID NO: 72 - protein, 429 aa, Mus musculus
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 73 - protein, 429 aa, Rattus norvegicus
MGPFCLGCSHRKCYSPIRNLISQETFKFHFKNLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 74 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 75 - protein, 384 aa, Pan troglodytes
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 76 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 77 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 78 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 79 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 80 - protein, 396 aa, Rattus norvegicus
MQPQGLGPNAGMGPVCLGCSHRRPYSPIRNPLKKLYQQTFYFHFKNVRYAWGRKNNFLCYEVNGMDCALPVPLRQGVFRKQGHIHAELCFIYWFHDKVLRVLSPMEEFKVTWYMSWSPCSKCAEQVARFLAAHRNLSLAIFSSRLYYYLRNPNYQQKLCRLIQEGVHVAAMDLPEFKKCWNKFVDNDGQPFRPWMRLRINFSFYDCKLQEIFSRMNLLREDVFYLQFNNSHRVKPVQNRYYRRKSYLCYQLERANGQEPLKGYLLYKKGEQHVEILFLEKMRSMELSQVRITCYLTWSPCPNCARQLAAFKKDHPDLILRIYTSRLYFYWRKKFQKGLCTLWRSGIHVDVMDLPQFADCWTNFVNPQRPFRPWNELEKNSWRIQRRLRRIKESWGL

SEQ ID NO: 81 - protein, 227 aa, Bos taurus
DGWEVAFRSGTVLKAGVLGVSMTEGWAGSGHPGQGACVWTPGTRNTMNLLREVLFKQQFGNQPRVPAPYYRRKTYLCYQLKQRNDLTLDRGCFRNKKQRHAEIRFIDKINSLDLNPSQSYKIICYITWSPCPNCANELVNFITRNNHLKLEIFASRLYFHWIKSFKMGLQDLQNAGISVAVMTHTEFEDCWEQFVDNQSRPFQPWDKLEQYSASIRRRLQRILTAPI

SEQ ID NO: 82 - protein, 490 aa, Pan troglodytes
MNPQIRNPMEWMYQRTFYYNFENEPILYGRSYTWLCYEVKIRRGHSNLLWDTGVFRGQMYSQPEHHAEMCFLSWFCGNQLSAYKCFQITWFVSWTPCPDCVAKLAKFLAEHPNVTLTISAARLYYYWERDYRRALCRLSQAGARVKIMDDEEFAYCWENFVYNEGQPFMPWYKFDDNYAFLHRTLKEIIRHLMDPDTFTFNFNNDPLVLRRHQTYLCYEVERLDNGTWVLMDQHMGFLCNEAKNLLCGFYGRHAELRFLDLVPSLQLDPAQIYRVTWFISWSPCFSWGCAGQVRAFLQENTHVRLRIFAARIYDYDPLYKEALQMLRDAGAQVSIMTYDEFEYCWDTFVYRQGCPFQPWDGLEEHSQALSGRLRAILQVRASSLCMVPHRPPPPPQSPGPCLPLCSEPPLGSLLPTGRPAPSLPFLLTASFSFPPPASLPPLPSLSLSPGHLPVPSFHSLTSCSIQPPCSSRIRETEGWASVSKEGRDLG

SEQ ID NO: 83 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 84 - protein, 190 aa, Gorilla gorilla
MNPQIRNPMKAMYPGTFYFQFKNLWEANDRNETWLCFTVEGIKRRSVVSWKTGVFRNQVDSETHCHAERCFLSWFCDDILSPNTNYQVTWYTSWSPCPECAGEVAEFLARHSNVNLTIFTARLYYFQDTDYQEGLRSLSQEGVAVKIMDYKDFKYCWENFVYNDDEPFKPWKGLKYNFRFLKRRLQEILE

SEQ ID NO: 85 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 86 - protein, 202 aa, Macaca mulatta
MDGSPASRPRHLMDPNTFTFNFNNDLSVRGRHQTYLCYEVERLDNGTWVPMDERRGFLCNKAKNVPCGDYGCHVELRFLCEVPSWQLDPAQTYRVTWFISWSPCFRRGCAGQVRVFLQENKHVRLRIFAARIYDYDPLYQEALRTLRDAGAQVSIMTYEEFKHCWDTFVDRQGRPFQPWDGLDEHSQALSGRLRAILQNQGN

SEQ ID NO: 87 - protein, 185 aa, Bos taurus
MDEYTFTENFNNQGWPSKTYLCYEMERLDGDATIPLDEYKGFVRNKGLDQPEKPCHAELYFLGKIHSWNLDRNQHYRLTCFISWSPCYDCAQKLTTFLKENHHISLHILASRIYTHNRFGCHQSGLCELQAAGARITIMTFEDFKHCWETFVDHKGKPFQPWEGLNVKSQALCTELQAILKTQQN

SEQ ID NO: 88 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 89 - protein, 210 aa, Macaca mulatta
MALLTAKTFSLQFNNKRRVNKPYYPRKALLCYQLTPQNGSTPTRGHLKNKKKDHAEIRFINKIKSMGLDETQCYQVTCYLTWSPCPSCAGELVDFIKAHRHLNLRIFASRLYYHWRPNYQEGLLLLCGSQVPVEVMGLPEFTDCWENFVDHKEPPSFNPSEKLEELDKNSQAIKRRLERIKSRSVDVLENGLRSLQLGPVTPSSSIRNSR

SEQ ID NO: 90 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 91 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 92 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 93 - protein, 229 aa, Rattus norvegicus [sequence omitted]

SEQ ID NO: 94 - protein, 224 aa, Homo sapiens
MAQKEEAAVATEAASQNGEDLENLDDPEKLKELIELPPFEIVTGERLPANFFKFQFRNVEYSSGRNKTFLCYVVEAQGKGGQVQASRGYLEDEHAAAHAEEAFFNTILPAFDPALRYNVTWYVSSSPCAACADRIIKTLSKTKNLRLLILVGRLFMWEEPEIQAALKKLKEAGCKLRIMKPQDFEYVWQNFVEQEEGESKAFQPWEDIQENFLYYEEKLADILK

SEQ ID NO: 95 - protein, 224 aa, Mus musculus
MAQKEEAAEAAAPASQNGDDLENLEDPEKLKELIDLPPFEIVTGVRLPVNFFKFQFRNVEYSSGRNKTFLCYVVEVQSKGGQAQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYIWQNFVEQEEGESKAFEPWEDIQENFLYYEEKLADILK

SEQ ID NO: 96 - protein, 224 aa, Rattus norvegicus
MAQKEEAAEAAAPASQNGDDLENLEDPEKLKELIDLPPFEIVTGVRLPVNFFKFQFRNVEYSSGRNKTFLCYVVEAQSKGGQVQATQGYLEDEHAGAHAEEAFFNTILPAFDPALKYNVTWYVSSSPCAACADRILKTLSKTKNLRLLILVSRLFMWEEPEVQAALKKLKEAGCKLRIMKPQDFEYLWQNFVEQEEGESKAFEPWEDIQENFLYYEEKLADILK

SEQ ID NO: 97 - protein, 224 aa, Bos taurus
MAQKEEAAAAAEPASQNGEEVENLEDPEKLKELIELPPFEIVTGERLPAHYFKFQFRNVEYSSGRNKTFLCYVVEAQSKGGQVQASRGYLEDEHATNHAEEAFFNSIMPTFDPALRYMVTWYVSSSPCAACADRIVKTLNKTKNLRLLILVGRLFMWEEPEIQAALRKLKEAGCRLRIMKPQDFEYIWQNFVEQEEGESKAFEPWEDIQENFLYYEEKLADILK

SEQ ID NO: 98 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 99 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQNQEN

SEQ ID NO: 100 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQ

SEQ ID NO: 101 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQ

SEQ ID NO: 102 - protein, 16 aa, Artificial Sequence
  Synthetic polypeptide
SGSETPGTSESATPES

SEQ ID NO: 103 - protein, 120 aa, Artificial Sequence
  Synthetic polypeptide
  MISC_FEATURE (5)..(120): May be absent
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 104 - protein, 120 aa, Artificial Sequence
  Synthetic polypeptide
  MISC_FEATURE (5)..(120): May be absent
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 105 - protein, 150 aa, Artificial Sequence
  Synthetic polypeptide
  MISC_FEATURE (6)..(150): May be absent
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 106 - protein, 150 aa, Artificial Sequence
  Synthetic polypeptide
  MISC_FEATURE (6)..(150): May be absent
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 107 - protein, 24 aa, Artificial Sequence
  Synthetic polypeptide
SGGSSGSETPGTSESATPESSGGS

SEQ ID NO: 108 - protein, 32 aa, Artificial Sequence
  Synthetic polypeptide
SGGSSGGSSGSETPGTSESATPESSGGSSGGS

SEQ ID NO: 109 - protein, 104 aa, Artificial Sequence
  Synthetic polypeptide
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 110 - DNA, 20 bp, Artificial Sequence
  Synthetic polynucleotide
gaacacaaagcatagactgc

SEQ ID NO: 111 - DNA, 20 bp, Artificial Sequence
  Synthetic polynucleotide
cttgtgtttcgtatctgacg

SEQ ID NO: 112 - DNA, 20 bp, Artificial Sequence
  Synthetic polynucleotide
gtcatcttagtcattacctg

SEQ ID NO: 113 - DNA, 20 bp, Artificial Sequence
  Synthetic polynucleotide
cagtagaatcagtaatggac

SEQ ID NO: 114 - DNA, 20 bp, Artificial Sequence
  Synthetic polynucleotide
ggaatcccttctgcagcacc

SEQ ID NO: 115 - protein, 1710 aa, Artificial Sequence
  Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 116 - protein, 1612 aa, Artificial Sequence
  Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 117 - protein, 1929 aa, Artificial Sequence
  Synthetic polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGS

SEQ ID NO: 118 - protein, 1385 aa, Artificial Sequence
  Synthetic polypeptide
SETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGS

SEQ ID NO: 119 - RNA, 82 nt, Artificial Sequence
  Synthetic polynucleotide
guuuuagagcuagaaauagcaaguuaaaauaaaggcuaguccguuaucaacuugaaaaaguggcaccgagucggugcuuuuu

SEQ ID NO: 120 - protein, 10 aa, Artificial Sequence
  Synthetic polypeptide
SGGSGGSGGS

SEQ ID NO: 121 - protein, 30 aa, Artificial Sequence
  Synthetic polypeptide
  MISC_FEATURE (2)..(30): May be absent
GGGGGGGGGGGGGGGGGGGGGGGGGGGGGG

SEQ ID NO: 122 - protein, 90 aa, Artificial Sequence
  Synthetic polypeptide
  MISC_FEATURE (4)..(90): May be absent
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 123 - protein, 60 aa, Artificial Sequence
  Synthetic polypeptide
  misc_feature (1)..(1): Xaa can be any naturally occurring amino acid
  MISC_FEATURE (3)..(60): May be absent
XPXPXPXPXPXPXPXPXPXPXPXPXPXPXPXPXPXPXPXPXPXPXPXPXPXPXPXPXPXP

What is claimed is:

1. A fusion protein comprising (i) a nucleic acid programmable DNA binding protein (napDNAbp) domain, wherein the napDNAbp domain when in association with a guide RNA (gRNA) specifically binds a target nucleic acid molecule; (ii) a cytidine deaminase domain, wherein the cytidine deaminase domain deaminates a cytosine base in the target nucleic acid molecule; and (iii) a uracil binding protein (UBP), wherein the UBP is a uracil DNA glycosylase (UDG) or a uracil base excision enzyme.

2. The fusion protein of claim 1, wherein the uracil binding protein is a uracil base excision enzyme.

3. The fusion protein of claim 1, wherein the uracil binding protein is a uracil DNA glycosylase (UDG).

4. The fusion protein of claim 1, wherein the uracil binding protein comprises an amino acid sequence that is at least 85% identical to the amino acid sequence of SEQ ID NO: 48 (UDG), SEQ ID NO: 49 (UdgX), SEQ ID NO: 50 (UdgX*), SEQ ID NO: 51 (UdgX_On), or SEQ ID NO: 53 (SMUG1).

5. The fusion protein of claim 4, wherein the uracil binding protein comprises the amino acid sequence of SEQ ID NO: 49 (UdgX), SEQ ID NO: 48 (UDG), SEQ ID NO: 50 (UdgX*), SEQ ID NO: 51 (UdgX_On), or SEQ ID NO: 53 (SMUG1).

6. The fusion protein of claim 1, wherein the fusion protein comprises the structure:

$NH_2$-[cytidine deaminase domain]-[napDNAbp domain]-[UBP]-COOH, wherein each instance of "]-[" comprises an optional linker.

7. The fusion protein of claim 1, wherein at least one of (i) the cytidine deaminase domain and the napDNAbp domain, and (ii) the napDNAbp domain and the UBP are fused via a linker.

8. The fusion protein of claim 1, wherein the fusion protein further comprises (iv) a nucleic acid polymerase domain (NAP).

9. The fusion protein of claim 8, wherein the nucleic acid polymerase domain has translesion polymerase activity.

10. The fusion protein of claim 8, wherein the nucleic acid polymerase domain is from Rev7, Rev1 complex, polymerase iota, polymerase kappa, or polymerase eta.

11. The fusion protein of claim 8, wherein the nucleic acid polymerase domain comprises an amino acid sequence that is at least 85% identical to the amino acid sequence of any one of SEQ ID NOs: 54-64.

12. The fusion protein of claim 8, wherein the fusion protein comprises the structure:

$NH_2$-[cytidine deaminase domain]-[napDNAbp domain]-[UBP]-[NAP]-COOH;

$NH_2$-[cytidine deaminase domain]-[napDNAbp domain]-[NAP]-[UBP]-COOH;

$NH_2$-[cytidine deaminase domain]-[NAP]-[napDNAbp domain]-[UBP]-COOH; or $NH_2$-[NAP]-[cytidine deaminase domain]-[napDNAbp domain]-[UBP]-COOH;

wherein each instance of "]-[" comprises an optional linker.

13. The fusion protein of claim 1, wherein the napDNAbp domain comprises an amino acid sequence that is at least 85% identical to any one of SEQ ID NOs: 4-26.

14. The fusion protein of claim 13, wherein the napDNAbp domain comprises the amino acid sequence of any one of SEQ ID NOs: 4-26.

15. The fusion protein of claim 1, wherein the napDNAbp domain is a Cas9 nickase (nCas9) or a nuclease inactive Cas9 (dCas9).

16. The fusion protein of claim 1, wherein the cytidine deaminase domain is a deaminase from the apolipoprotein B mRNA-editing complex (APOBEC) family.

17. The fusion protein of claim 16, wherein the deaminase is selected from the group consisting of APOBEC1 deaminase, APOBEC2 deaminase, APOBEC3A deaminase, APOBEC3B deaminase, APOBEC3C deaminase, APOBEC3D deaminase, APOBEC3F deaminase, APOBEC3G deaminase, and APOBEC3H deaminase.

18. The fusion protein of claim 1, wherein the cytidine deaminase domain comprises (i) an amino acid sequence that is at least 85% identical to an amino acid sequence of any one of SEQ ID NOs: 67-101.

19. The fusion protein of claim 1, wherein the cytidine deaminase domain is a rat APOBEC1 (rAPOBEC1) deaminase comprising one or more mutations selected from the group consisting of W90Y, R126E, and R132E of SEQ ID NO: 93.

20. A fusion protein comprising:
(i) a first domain comprising an amino acid sequence that is at least 85% identical to the amino acid sequence of any one of SEQ ID NOs: 4-40;
(ii) a second domain comprising an amino acid sequence that is at least 85% identical to the amino acid sequence of any one of SEQ ID NOs: 67-101; and
(iii) a third domain comprising an amino acid sequence that is at least 85% identical to the amino acid sequence of any one of SEQ ID NOs: 48-53.

21. A complex comprising a nucleic acid molecule and the fusion protein of claim 1.

22. A pharmaceutical composition comprising the fusion protein of claim 1 and a pharmaceutically acceptable excipient.

23. A method comprising contacting a nucleic acid molecule with the fusion protein of claim 1.

24. A method of editing a nucleobase pair of a double-stranded DNA sequence, the method comprising:
contacting a target region of the double-stranded DNA sequence with a complex comprising the fusion protein of claim 1 and a guide nucleic acid, wherein the target region comprises a target nucleobase pair; and thereby:
inducing strand separation of said target region; and
excising a cytosine or a thymine in a single strand of the target region.

25. A method of treating a subject having or suspected of having a disease or disorder comprising administering the fusion protein of claim 1 ex vivo to a cell from the subject.

26. The fusion protein of claim 20, wherein:
(i) the first domain comprises the amino acid sequence of any one of SEQ ID NOs: 4-40;
(ii) the second domain comprises the amino acid sequence of any one of SEQ ID NOs: 67-101; and
(iii) the third domain comprises the amino acid sequence of any one of SEQ ID NOs: 48-53.

27. The fusion protein of claim 1, wherein the uracil binding protein comprises the amino acid sequence of SEQ ID NO: 49 (UdgX).

28. The fusion protein of claim 1, wherein the uracil binding protein comprises a UdgX or UdgX*.

29. The fusion protein of claim 7, wherein the linker comprises the amino acid sequence of any one of SEQ ID NOs: 102-109, 120, and 123.

30. The fusion protein of claim 18, wherein the fusion protein comprises an amino acid sequence of any one of SEQ ID NOs: 67-101.

31. A cell comprising the fusion protein of claim 1.

* * * * *